United States Patent 12,642,819 (COMPOSITIONS AND METHODS FOR TREATING INFLAMMATORY BOWEL DISEASE) - sequence listing, part 83

SEQ ID NO: 42 - DNA, 5057802 bp, Escherichia coli (residues 1,685,935-3,371,868 of 5,057,802)
  modified_base (44160)..(44259): a, c, t, g, unknown or other
  modified_base (330570)..(330668): a, c, t, g, unknown or other
  modified_base (524578)..(524672): a, c, t, g, unknown or other
  modified_base (2560391)..(2560489): a, c, t, g, unknown or other
  modified_base (2725901)..(2725997): a, c, t, g, unknown or other
  modified_base (4460096)..(4460742): a, c, t, g, unknown or other
  modified_base (5000830)..(5001137): a, c, t, g, unknown or other
  modified_base (5023608)..(5023722): a, c, t, g, unknown or other
tctaacgcaccgggcgatgtggagatggcacgcgcgctgcctgccagatcgctggcgatgatcgtcggtggtcactcgcaagatccagtctgtatggcggcagaaaacaaaaaacaggtcgattacgtgccgggtacgccatgcaaaccggatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctgtacacccctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtacgttttgtacagaccaatatggggcggttgattctggcagcacaaatggatcgcactggtgccgactttgcggtgatgagcggaggaggaattcgtgattctatcgaagctggcgatatcagctataaaaacgtgctgaaagtgcagccattcggcaatgtggtggtgtatgccgacatgaccggtaaagaggtgattgattacctgacagccgtcgcacaaatgaagccagattcaggtgcctacccgcaatttgccaacgttagctttgtggcgaaagacggcaaactgaacgacctgaaaatcaaaggcgaaccggtcgatccggcgaaaacttaccgtatggcgacattaaacttcaatgccaccggcggtgatggctatccgcgccttgataacaaaccgggctatgtgaataccggctttattgatgccgaagtgctgaaagcgtatatacagaaaagctcgccgctggatgtgagtgtttatgaaccgaaaggtgaggtgagctggcagtaatgaaccccgtcgcggcgtcatgatatgacgccgccatttatgaatattgaaatcttgcatcgtaatcgcgatgtgtcaaaccaaatgccatcagcatataattctgcggatcaccaggctgttcttcatctgcttcaaaccaaagtgtcacgcctgagcgattgacgtggattaagagtgtatggggcgattgacggcggatttgcagatcagcgccttcgttaacaagcatgttaaatacacgcgtaacgttcaactcagcgacgttattcaatattcctttatcaaatcggatcgctttgcccaaatggatttggctcagataatcgcaccaaatcatatatagcttgttgttttcgaaatgaaactcaacattaccaaatagccagatataaaaaccatttcccatatcatttttagagtccggctcaacaaagttttgttccaaccatgccattgtttgccccagttcgacaaaatcgaattttccgttaaagacaaaattgtggaagctaacatcaacaagatggtcaaatttcatctttcgctcctttgtgaattttttacatgcttcaaaagccagcgtaatttacatcggtgcaggcgactctccagtgttgagcgaaaatttgcgatgtcgacattggaccgatctaccgcagcaacccccgtgtattgtgggatcggtgaagggattttttgtaactttcccagcgccagcagttgttgaatgatcctgctaccgtcgtggtaatcatcgtaaatagccactggcagaggctgccaggcgggggtcgatttgataaatccggaaaaaaaatacgggtccagatcgccgaaatcaaagccgtaggcgaggggaacttcaatattttgctctgtttttttattctcaaatgtacaatgaaaaccgtgaaaacaatactgccactttcccattttgccttttcgcttacggttgcatttgaagggggcaaaggtaactagcgggttattttccgccatctcaacgttcagttgttcagccaatgcaaatataagctctgtcgccagcttacgatattctttcgcgcagtgttcgaaaaaatcctgatggcggttaatctcttcaagcgatattaatctggcgatcctgataaccgggtcggcagaatgcatgccaacaacaaattcatcgagctgtgctttcagcaccagcccgaattcctcacgatacctctctgcttcgctggcaaaatgcagatgtaataccttctctctcgatgtttgccgaagtaaggcgatatccggtatctcatctgcacaagcgatacttaatgtctctgtaatcctttccacatctcatcttccgtgtgcatcacttaatcgcgacgggcgatatcagcaaatttggcatcgagtatctttgccaggtcgcttgccgccagttcgatatccagtccgcgcttgccgccggaaacataaatagtggcaaattcttgtgcgggggcgtcgataatcgttggcagacgttttttctgccccagtgggctaatcccccctaccagataccccgtcgaacgctgcgcgaccatcggatcggccatctcaactttcttggcacccagcgcttttgctacttttttaagatccagttgacctgcgaccggcgtaacagccacggcaaggtgtttcatatcaccgttcactgcgaccagcagcgttttgtagacctgatccggattcaaacctaattttttgacgacttcatcgccaaaattggtttcagcaggatcgtgctcgtaggtgtggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatctgcggcaaattcccttctccatacaggtgtagtgcaccaaccgcgaccacatatcgccccggcggcatggcgcgtaatttatcccgccaggcgagatttcgctgatgcatcagcacatcgtacagcgactgactgaacgtattgggcaacgttatttcattattttgcggcggtgcattcagccaccagctcatcatttgttgcagcaaccgtgcgttggtgtgccagtgggtcagcgtatcgtccagcagtgccagtcctttgtcagggagctggagcaacatggcaatctggttttcagccccttccagttcaatcacgggtttatgttgttgcttagccgcctgcaatagctggtaatcgataccgtattctgcccgcagccccagtttttgcgcctgcgtcgcctgaagaaccatcgcgatttgccacagcggttgggtagaaaagagcgacggagaaatgcccatctcctggctaatgtgctgcaggttttggagttggtcctcgctaatgcgctcttccagggcctcgcaggcaggcaaattggcaaaaggcgtatcgctggtggaaacatccgcctcgacgatcagcgcatcggcgtttttgagctttttgagcaaacgggtgggcaggggagccatatcgtggctacccatatgaatactgccgatcagatgaaaatggcgattgccgggaagagagatatcgatagcaggccaggtgtaatgattaccgcgcagcgcggcccaaagcgtttttacccggtacaacagatccatacgacctccctttgtgaaatatcatgctagcgcgcggggagggatggcgcaaatggagttgattgttgcacttgcgcacagtgcttgtgtgcattacaatgattaaataatggacaaggagatgagagaggaatggctcaaaagaaaaatataaggagttttcgtgatgcctggttggctgatttttttgtccattcaacgccacatcgaaagatccctgctgaaatccataccacgttatcacgaaagttggacatcattaatgctgccacttctcatcgggatttacgctcccctccggggaaccgatacgaagagttatccgggaaattacaggaatactcctccattagagtgaataaacagtaccgactgatttttaaatgggttaatggcaaggccgaagaattgtttttagacccacacaactactaaaacatagctgtcgtattgacgagaaaggtaaaactatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcaccactgagatggcattccgtctggcgaaagtttttgataccacagtcgatttttggctaaacctccaggcggcagttgatctttgggaagttgaaaacaacatgcgtacccaggaagaattgggacggattgaaacagtggctgaatatttggcacgtcgtgaagagcgtgcaaaaaaggtcgcgtagaataatttccctataacggatgcgccaccctaaagcagcgcatccgcaatgatgtacttattccttcggtttaaaccgcagcaagcggttggcgttactcactacggtgatcgacgagagcgccattgccgctccggcaaccaccgggttaagcagtgttccagtgaacggccacaaaataccggcggcgaccggaataccaatgctgttgtagataaacgcaccgagcaggttctgcttcatgttgcgcagcgttgcgcgggaaattgcgagcgcatccgcaacacccatcaggctatggcgcatcagggtaatcgccgcggtttcaatggcaacatcactgccgccacccatcgcaataccgacatccgcctgagccagcgctggcgcatcgttaatgccgtcgcccaccattgctacctgacgtccttcactttgcagacgtttgatcgcttcggctttaccgtccggcagcaccccggctatcacctcatcaatcccggcttctttggcgatcgcattggcggtggttgggttatccccggtcaacatcaccagacgatatcccgctttatgcaggcgttgcagcgccgccacgctatcactacgcaatggatcgcgtacagccagcagggctaccgctttcccgtcaaccgccagcagcacaggcgttgccccttgcgatgcctgagctgaaatatctgcttcaatcgctttagtatcaacttgctggtcatttaacagcgcctgattgcccagcaataacgcatgaccttcagcttcaccgctcacgcccagcccgcgcaatgtgcggaaaccgttgacctgcggcagctgcatatcgcctgctttatcgaggatcgctcgtgccagcggatggctggaaccttgctccagtgccgccgccagacgcaatgcctgcgcttcatcaacatcagcaaacgttttcactgcgacaacctgcggtttaccttcggtcagcgtcccggttttatcgaacacgacggtatcgagcgtactggcgcgttgcagcgcgtcggcgtcccgtaccagcacgccaaactcagccgcccgcccgacgcccgaaataatcgacatcggcgtcgccagccccagcgcacacggacaggcaataatcagcaccgtggtggcaatcaccagggtatagacaatctgcggtgccggaccaaagaaataccagattgccgcactgatcagcgcaatcaccaccactaccggcacaaatacggctgagattttatccgccagttggccgatttcaggcttgctgctctgggcctggcgcaccatgcgaatgatccgtgacagcgtagtatggctgccgaccgcactagcacgaaacagcacgctaccgtcctgcaccactgtcccggcatggacgctatcgccttcgcctttttgctgcgggataggttcgcccgtcagcatcgcttcatccagccacgcttcgccttgagtaatctcaccatctaccggcacacggtcgccggtcgtcaggcgcagtaacatacctggctgaacatctgccagcggcacgtttttttcaccttcgtcggtgaccaggcgcgccgtcggtggggttaaatcgagtaatttctccagcgccttagaagaacgctgacgcgcgcgcgcttccagcatatggccgagattgatcagaccgataatcatcgcgctggcttcgtaataaagatgtcgcgcttccatcgggaaccactgcggccacaggttgacgctcatcgaatagagccacgccacgccagtacccagcgccaccagcgtatccatcgtcgccgcaccgttcagcaggcttttccatgcgctgcggtaaaaatgcccgccggcgaaaaccattaccgccagggttatcaggccgataactaaccacaggctgcggttgtcagcggtgaccatcatgttatcgccgatcatcccccagaccatcactgggatacccaccgccagcgcgacaattgcctgccagcggaagcgcttcatcgtagcgacggcggtttcttgctggcgctcgcggcgtttagcgtcatcttcaatcgcttccgcgccgtagcccgctttttccaccgcctgcactaaatcttgtggggaggcactgcccatcaccagcgcagtacgctccgccaggtttacccgtgcctgagtgacgcccggtacgctttgcaacgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgttcaacatccgggcgctgttcgagactttctttcacgcgtttaacgcagtgaccgcaggacaggccgtccagggtcaggtcgatagtttgtgacataaaacactcctttaagacagttttgactggctgtgacaaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcctgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgactacattccctttctggcgaatgtccctggtcaactggcggcagtggctattgtgacctgcgatggcaacatctatcgcgcgggtgatagtgattaccgctttgcgctggaatccatctcgaaagtctgtacgttagcccttgcgttagaagatgtcggcccgcaggcggtacaggacaaagttggcgctgacccgaccggattgccctttaactcagttatcgccttagagttgcatggcggcaaaccgctttcgccactggtaaatgctggggctattgccaccaccagcctgattaacgctgaaaatactgaacaacgctggcagcgaattttacatatccaacaacaactggctggtgagcaggtagcgctctctgatgaagtcaaccagtcggaacaaacaaccaacttccataaccgggccattgcctggctgctgtactccgccggatatctctattgtgatgcaatggaagcctgtgacgtgtatacccgtcagtgctccacgctcatcaatactattgaactggcaacgcttggcgcgacgctggcagcggggggtgtgaatccgctgacgcataaacgcgttcttcaggccgacaatgtgccgtacattctggccgaaatgatgatggaaggactgtatggtcgctccggtgactgggcgtatcgcgttggtttaccgggcaaaagcggtgtaggtggcggtattctggcggtcgttcctggcgtgatgggaattgccgcgttttcaccaccgctggacgaagaaggcaacagtgttcgcggtcaaaaaatggtggcatcggtcgctaagcaactcggctataacgtgtttaagggctgatcatgatgaacacggaaggtaataacggtaacaaacctctcggtctatggaacgtcgtttccatcggcattggggcaatggtgggggcggggatcttcgcgctgctggggcaggctgcgttgctaatggaagcctcgacctgggtcgcctttgcttttggcggtattgtggcgatgttttccggttatgcctatgcgcgtctgggggcgagctatcccagcaatggcggtattatcgacttctttcgtcgcggattaggcaacggcgttttttcgctggcgctctcgttattgtacctgttgacgctggcggtgagtatcgccatggtcgctcgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgatcattgccggtgtctggtcgctgcaaccggcgcatatttccgtctctgcgccccccagctccggtgcgttcttctcctgtatcgggataaccttccttgcctatgcgggctttggcatgatggcgaacgcggcggataaagtgaaagatccggaggtcataatgccacgggcgtttctggtggcgattggcgttaccacgttgctttatatctcgctggcactggttttgcttagcgatgtatcggcattagagttagaaaaatatgccgataccgccgtagcgcaggctgcttctccgctcctcgggcatgtggggtatgtgatcgtcgtcatcggcgctttactggcgacggcttcagccatcaacgcaaacctgttcgccgtgtttaacattatggacaacatgggcagcgaacgcgaactgccgaagctaatgaataaacctctgtggcggcagagtacctggggcaacatcatcgtcgtggtgttgattatgctgatgacggcggcgctgaatttaggctcactcgccagcgttgccagcgccacctttttgatctgctatctggcggtgtttgtggtggcgatccgcctgcgtcatgatattcacgcctcgttgccgattcttatcgttggtacgttggttatgttgttggtgatcgttggctttatctacagtctctggtcccagggcagccgtgcgctgatatggattattggcgcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatttgttgaaaccctttaacaaagcacaggaggcgttgcgcgaacgatgaacattagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacgccaggtgggctttaacctggaggagagcggcgaactggtgaatctgtttaacgatccgcagcgtcacagcgccgacgtcaaacgtcgtacgctggagaaagtagcggagatcgaacagcatatcgaagaactgcaatccatgcgtaaccagctgctggcgctagcgaatgcctgccccggtgatgacagcgccgactgcccgattatcgaaaatctttccggctgctgtcatcatcgggcggggtgattaaggcttgcgaaaatagtcgtccattattttcgtcaactccggacgttccccgtcatcattgatggcaaaatccagaaaaaaagcatctgcttgcggcgttcggttttgcgccatcaaccggaaggtgagggggcgataaatggcgtatgccggatggctgataacgaatcgggcaaagtcaataaaaagcggcgagtgtgtggaaaacagcgcctgcaaaataatatcagccttttcatcctcccccaaaccttgttggatcatgctcttaatacgagtttcgctcaaattcccggcctcaacaatttgccaggcttgatccagcgaggggtaccgactgacgctctgctttaactcttctgaccaggtttcggatgggctgatgtgcttatcagggccgaaactctcccatgcgctgggcggtaatgttttgcacgcggtgagttttggtatgtggtattgcagctctgttttgtgcagacattccccgccaggaaataccagggtttgttgctcatcattaaaatgggttgccgtgctgagcaccagtgttttgagcggtcgcccttccagcgcggcggcagtagccttatggtgtccgtcgagcagaacgcagagataggaatcagggagataccaggccagagcgcgggcgtccggtttatcgcgataaaacgtcgcacgctcaggattaaaatgtgatggcggctggccgggtagaagaaagcagggcgcggtgtcactgaaagagcaatattcaggatcccagacggcaacggttgccggattactggaactatggtccgttgccgcccaaaagaaatgcccgttgccatccgtcgggtaaagttcacgatcttccagcaaataataaccatcagccatgcatgtgaacagcggtgtcagcgcggcaaaagcgtccgttatgccagaccacgggcgattccagttttcgagagcagacaaaaaccgggcggctccctgttcatcctccgtaaaaccgctgtagacaaatttcgcacatgtagggcatccagcctcggaccagaaacgtattaacgggacatcctgccagcagagcgaatggataagaccgtgcgagtgcggatcgtaaatcacacattgacgcagaaatcctttcccggacttcaccgaaaaaatgacgcccgcagcggtatttttcagcagacgtacttcaggttttcgaaagggggaaaacatggctactccttagccgaacattcaattaacactatgtagggggctatatgccggatgcggcgtaaacgccttatccggcatggggtttggtacagatttccaggtgtgataagacgcgtcaggcgatgaccgcacggataatcagcgttatcccttctatcgcaatcacctcaacatgcgtacctgcactgagatcctcgctggcgctgacaggccatgaactgtcaccgacgcgcatatgaccgcgcccgttgaccagcggagattccagcacaaaacgtcggccaataagctgctgcccgcgctggtttaaatgactgtcgctgtgcttttgttcgcgcacccgccgcgacagccatttccaccacaaccaggcggcgagcagtgtcagaatggcaaacatcaccccttgccactcccaacccagcggcaccagccagaccaccaggccggtaatcaccgctgccacgccgctccacaacagataaccatttccgcccaacatctcggctgccagcagcaacccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcaccactttgctgttactggacgaaccgatctgctgtaacgcttcggtgtatttctgtgcgacgaagtagttcaccgcctgaatatcaccggaggcgatggcttcagacaccattttggtggcgcgggcttctgcttcagcggaacgttcacgcgcttcagcctgtaaaaacgccgactgacgttcgccttccgctttcaggatttgcgactgtttttcaccttcggctttgaggatttccgcctgacggatcccttccgcttcaaggatgtaagcgcgtttggtacgttccgctttcatctgcgcgttcattgaagagataagctctgcgggcgggcgcacatcacgaatttcgatacgggtgactttaatcccccacgggttggtggcctcatcgacaatacgcagcaggcgtgagttgatgctgtcgcgctgagagagcatttcatcaagttccattgaacccaacacggtacggatgttagtcatggtcaggttgatgatcgccagctccagattgctgacttcataagcggcgcgcggggcatcaatcacctgaataaagcacacggcgtcgatggtaacgttggcgttatctttcgagataacttcctgggaagggatgtcgagcacttgctccatcatattgatcttgcgaccaatgcgatccataaacggcaccaccagactgagccccggctgtaacgttttggtatagcgaccaaaacgttctaccgtccattgatagccctgcggcacgattttgacgcccgcgccgacaatgaccagcgcgacaaaaataagaatagggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagtgatgcaggaaaatagtcctttgcttcagctacaaaacgtaggatatctggcgggtgatgcgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggtgaggatgtcagcacactaaagccagaaatctaccgccagcaagtgtcttactgcgcccagacgccgacgctgtttggcgatacggtatacgataacctgatttttccctggcagatccgtaatcagcagcctgacccggccatttttctcgattttctcgaacgcttcgctttgccggacaccattttgacgaaaaatatcgccgagctatctgggggtgaaaaacaacgcatctcattgattcgtaacctgcaatttatgccgaaggttttattgctggatgaaatcaccagtgcgctggatgaaagtaataaacataacgttaatgagatgatccatcgttatgtgcacgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattggcactggcattaatgctggtggtggtggcaatcttaattagccataaagaaaaactggcgctggagaaagatattctctggagcgtcgggcgcgcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattactctggcggtgctgattttatcgggatcgattgagtttatcccgatgcaggtgatccctatcgccgggatgatagccggtaacgccatggtagcggtggggttgtgttacaacaatttagggcaacgggttattagcgaacagcaacagattcaggagaaactgagtcttggcgcgacgccgaaacaggcttcagcgatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaactgccagcctgtcgaccattattgcctgctatttaacctatcgtaaattttataattcgcgccaccaattggtggtgacgcaattgaagaagaaatgatgcgatgccggacgcgcagcatcgcatccggcgttgtggttcatgtgccgatcaacggaaactcaatacaacaacgcgtacagctggcggcgatacttcgacgccagtgcatcacccgtacccagcgcagcgaggatctcctggaatgttttacgtgtctgaccatctgcggcggtgagatctttacgcagatgcccaaacagtaactccagcgcctcttcattgcgcccaacctggtgcagttgcagtgccagttgcgtcgccagtgcggcatcttctggattctccgccacctgctgttgcaactgttgaatttccggcgtatctgccgcctgcttcagcagttcgatttgcgccaccagcccctggtagcgggtgtcctgatcctgcaatggaatggttttaagcaccgcttctgcatcttcagaacggttcagcgcaatcagcgtttctgccaacagcaggccgatttccccgttctgattcgacaactgccaggcgtctttcagcaatggcagggcgtcggtgtaattgccttcctgcatcagttgcatcgcctgctgcgctttcagctcttcttcacgcggcagcactttatccagcagggcgcggatcgcctcttccggttgcggcccctggaagccgtctactggttgcccgttctggaacagatatacggtcggaatcgcgcgcagaccaaactgggcggcaatcatctgctccgcgtcgcagtccagcttcgccagaataaattgcccgttgtactgcgccgcgaggctttccagaattggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattactgcccaggtcaccagcgttaccggatagcgcatcttcggcttctcgctaataaaagcatggcgcactttgtcgaccaccgcttccggtcccagcgtaaagcgggcggcgatgccaggattttcgactggtttatcactttgcgtctgattgacgttgtcggtgaagcgagtacgaatgggaccaggttcgatcaggctgactttaattccgctgtggcgcagctccatgcgcagtgcgtctgaccacgcctccagcgcatatttactggccgcgtaagcgccacgacccggtgtggagattaatcccatcaccgatgaggtcatcacaatacgcccttcaccgtgcggcaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacttcgtcggctgcgcgatcaacactttctggcgaatccagatcgatcaacacgccggtaaatcccatgctgttcatgcgctcaacatcatccggtttccggcaacctgccagcacatgaaaaccctggcgttttaattcgagcgcgctttccaggccaataccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtttgctcggtttgctgtggttgaaaaccacgcaaaccgtcattgccgcccagttcaaccagcacccagcgcggctgatgctgtttcagcagagccggaaggcgcgccagcccttgttgcgaggtgtcgccgctgatgctggcattgactaccgacgttttactctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggctggatgacggcagcagtggcgaagtgagactggtgggacaaccgctacataatatggacgaagaagcgcgggcaaagttgcgcgcgaagcacgtaggctttgtttttcagtcatttatgttaattcctacccttaacgcgctggaaaacgtcgagcttccggcgctgctgcgcggtgagagtagcgcagaaagtcgtaacggggcgaaagcgttgctcgaacagttaggactgggtaaacgtctggatcatcttccggcacagctttccggcggcgaacagcaacgagtggcgctggcgcgagcttttaatggtcggcctgatgtgctgtttgccgacgaacccaccggcaatcttgaccgccagacgggcgataaaattgccgacctgctgttttccctcaaccgtgagcatggcaccacgttgattatggtgacccatgacctgcaactggcggcacgctgtgaccgctgcttacggctggtgaacgggcagttgcaggaggaaacatgattgcacgttggttctggcgcgaatggcgctcgccgtcgctattaattgtctggctggcgttaagcctggcggtggcctgcgtgctggcgctgggcaatatcagcgatcgcatggagaaaggtttaagccagcaaagccgtgagtttatggcgggcgatagggcgttgcgcagttcgcgcgaagtgccgcaagcgtggctggaggaagcgcaaaagcgcggcctgaaagtcggcaagcagctgactttcgccaccatgacctttgcaggcgacacaccgcagctggcgaacgtcaaagcggtggatgatatctacccgatgtatggcgagctacaaaccaatccccctggcctgaaaccgcaggcgggcagcgtattgctggccccacgcctgatggcgctccttaacctgaaaacgggcgacaccatcgacgtgggcgatgctaccttgcggattgccggagaagtgattcaggaaccggattccggttttaatcctttccagatagccccacgcctgatgatgaatctggcggatgttgataaaaccggagccgtgcagccggggagtcgggtcacctggcgttataaattcggcggcagcgagaaccagctcgacggctatgagaaatggttgttaccccagcttaaacctgaacaacgctggtacggtctggaacaggacgaaggcgcgctggggcgatcgatagaacgttcgcaacagttcctgctgctttcggcgcttctgaccttgctgctggcggtggcggcggttgcggtggcgatgaatcattactgtcgcagtcgctacgacttggtggcgatcctcaagacgctgggggcagggcgagcgcaactgcgtaagttaatcgtcggtcagtggttgatggtgctggcgctttcagccgttaccggtggggcgataggcctgttgttcgaaaacgtgttgatggtgctgctcaagcccgttctgcctgctgcactaccgccagccagcctctggccgtggctgtgggcgctcggcaccatgacggttatttcgctgctggtggggctacgaccgtaccgactgttactggccacgcagcctttacgcgtattacgtaatgatgtggtagcgaacgtctggccgctgaagttttatctgccgattgtcaccgtggtggttgtgctgctgctcgccggactgatgggtggcagtatgctgctctgggcggtgctggcgggcgcggtagtactggctttgctgtgcggtgtgctgggctggatgctgctgaatgtacttcgccgcatgacgctgaaatcgctacctctgcgcctggcggttagccgcctgttacgtcagccgtggtcaacgttaagccagctttcggcattttcgctctcctttatgctgctggcactgttgctggtgttgcgtggcgatctgctcgaccgttggcaacaacaactgccgccagaaagcccgaactactttttaatcaacatcgctacggaacaggttacgccgctgaaagcgtttctcgcggaacatcagatagtcccggaatcgttttatccggtggtgcgggcgcggttgacggcgattaacgataagccgacagaaggcaatgaagatgaggcgctcaaccgcgagctgaatctcacctggcaaaatacgcggcccgatcataatccgattgtcgccggtaactggccgccaaaagccgatgaagtgtcgatggaagaggggctggcgaaacgcttaaacgttgccctcggcgataccgtgacttttatgggcgatacccaggagttccgcgctaaagtgaccagcctgcgcaaagtggactgggaaagtctgcggcctaatttctattttattttcccggaaggggcattagacgggcaaccgcagagctggcttaccagtttccgctgggagaatggcaacggcatgttgacgcaactcaaccgccagttcccgaccattagcctgttagacattggcgcgattttaaaacaggtcggtcaggtgctggagcaggtaagtcgggcgctggaagtgatggtggtgctggtcaccgcctgcggcatgttgctgttgctggcgcaggtgcaggtgggaatgcgtcagcgtcatcaggagctggtggtgtggcgcacacttggtgcggggaaaaaactgctgcgcacgacattgtggtgtgagttcgccatgctcgggtttgtatccggcctggtggccgcaatcggtgcggaaacggcactggcggtactgcaatcgaaagtgtttgatttcccgtgggagccagactggcgattgtggattgtgctgccgtgcagcggtgcgctactgctgtcgctttgcggcggctggctgggtgcgcgactgcttaagggtaaggcgctgttcaggcagtttgcggggtgatgacaggtgttagattgcctgatgcgctacgcttatcaggcctacgaagatcgtgcaatatattgagttttcgaaattttgtaggctggataaggcgttcacgccgcatccggcatgaacagcgtgcacagaatcccccatcactgcgccttaacccattccgccacttccgcccactcaccgcgaaagacaactttttccgcttttttctcaagctgatagcgatacatcgggtcgtaatattcttcaagtaacggcaccagccaggccagatgaccgtcggtgctgccggtggtgagttgcgttgtcagcgccgcatccagccttgcagccagttcgttatagcgttgtagtcccagccgacgtttaatcgccgaaagcccgtgatgcaggtattcgcaatactcctgccagccctgttcgtcgccataagcgtgggtaaaatcatgatgcatacgcaagaaatattcttcgttcaggcgttcaagacggatctcaaacggatcttctaccaccgcaatcgtcgcctgagtcattcgttcgcgcagacattccggcaggtgattcgaaccgatcatccggctttcatcttccagcacccacaggcgcaaatcctgatgggcgtcggtttttagcatttcggcagccagcaggttttcaaaactcgcctggctaagttgtggttgtaacgtgcgaccaaaagcagaaccgcgatggcgcgccagcccttccagatcaacaccgttcggttgttgttgcactaacagcgttttgccgcagccggtacaaccgccaatcagcactatcggtttttgtgacagttcaatggtcgcctgaatcgcggtctggcgcagtgccttataaccgccttccaccagcggataatcaatccccgcgtcatgcagccagcgttgcacaatatgcgagcgctgaccgccacgggcgcagcagagaataccgtgcggattttgcaggcacgctgcccgccaggcgtctatacgctgctgacgaatttcacccgccaccagcttatgccccagtgccagcgccgcgtctgacccttgctgtttatagcagatgccaacggcggcgcgttcatcgttattcattaacggtaggttgatagcggcgggcattgcgccttgctcaaactcgatgggggcgcgaacatcaataatgggcgtatcagcaatcagcagggcacgatagtcctgttccgtgtgtctctcttgcatagtaaaaagtgaacctcaaatcagcttgcgcgctattttacgcgccaacgtgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgagcattgactggcaaagtgattttggcaaaaaaccaatgcccacgcccgccagatgggcggcgattttcgtttccatatcgggaacaataatctctttttgccccggcaatcgccaggcgacgcgtttggttaatgtacgggcgctgtcttcaatattgaccgccggaaagcgccgcaactgtgcttctgttagcggctcttcaacgttcgccagcggatgatccgccgccatgacaaagcgccattgcaccgatcctaagggatcaagactaaaggtatttgccagcgcctcggttcccgtgacgccgatagccagtgaaaaaccttcgtacaatagcgagtcccagacgcccatatagatttgtcgggagatgtgaaattgggtaaacgggtaacgttcatttagccacgccagcagcctggcaacggcctgggggttatagagcaggttgttgatgacgatattcacctggcgttccacgccatcattcacctgttgtaactcgctgggcatactttccagccagctcagccagtctctggcctgacaaagtagatgctcgccagccgccgtcaacgtcacgctgcgagtcgtgcggaaaaacagcgccactccggtattctcttccagaagtttaatgcgataactgatcgtcgccgtggttttacataatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtgttgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagaaacgggattttttccatattaacaatggactggtggagcgttaccacgatttggcgctggttgagattcttgagcaagaccgtacgcttatcagcattaaccgcgcgcaaccggcgaatctgccgctgactattcacgaactcgaacgtcatccgctgggtacacaggcgtttatcccgatgaaaggtgaagtgtttgtggtggtggtggcgttaggtgacgacaaaccagacctgtcaaccctgcgggcgtttattaccaatggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaacgaattgttcattgtttatgctcatttgtaggtcggagttaacgtaggtatgacggaagttagacggcgcggcaggccaggacaggcggagcctgtggcacagaagggtgcacaggcgttagagcggggaattgcgattctgcaatatctggaaaaaagtgggggaagttcgtcggttagcgatatctctctcaatctggatttgccgctctccacgacctttcgcttgctgaaggttttacaggcagcggattttgtctatcaggacagtcagttaggctggtggcatataggattaggtgtctttaacgtcggtgcagcgtacatccataaccgcgatgtactctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccgctgggcagtcgtctgccgctgcatgcttccggagcgggcaaggcgctgctttatccgctggcggaagaagagttgatgagcatcattctgcaaaccggtttgcagcagtttacgccaacgacgcttgtggatatgcccaccttgctgaaggacctggaacaagcgcgtgaactgggctataccgtagataaagaagagcatgttgtcggcctgaattgcatagcttcagcaatttacgatgatgtaggtagtgttgttgccgctatctccatctccgggccttcatcaagactgacagaagatcgttttgtcagtcagggtgagctggtcagagacaccgcccgcgatataagcacggcgttgggactgaaagcacatccatagtgtctgtcgtatcccgctctgcggagcgggtttttttgacaaaatttgagagttggaaaaattttccaattaatagaggtaggaataaaatggcaaaaatgagagccgttgacgcggcaatgtatgtgctggagaaagaaggtatcaccaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcttctgctgattccattcctattctgtgtattaccggccaggctccgcgcgcccgtctgcataaagaagatttccaggccgttgatattgaagcaattgctaaaccggtcagcaaaatggcggttacagttcgtgaagcggcgctggtgcctcgtgtgctgcaacaggcgtttcacctgatgcgttctggtcgaccgggtccggtactggtggatttaccgttcgacgtacaggttgcggaaatcgagtttgatcctgatatgtacgaaccgctgccggtctacaaacctgctgccagccgtatgcagatcgaaaaagctgtagaaatgttaatccaggccgaacgtccggtgattgttgccggaggcggggtaattaatgctgacgcagctgtactgttacaacagtttgctgaactgaccagcattccggtgatcccaacgctgatgggctggggctgtatcccggacgatcatgaactgatggccgggatggtgggcctgcaaaccgcgcatcgttacggtaatgcaacgttgctggcgtccgacatggtgtttggtatcggtaaccgttttgctaatcgtcataccggttcggtagagaaatacaccgaagggcgcaaaatcgttcatatcgatattgagccgacgcaaattggccgcgtactgtgtccggatcttggcattgtctctgatgctaaagcggcgctgacgctgctggttgaagtggcgcaggagatgcaaaaagccggtcgtctgccgtgtcgtaaagaatgggtcaccgactgccagcagcgcaaacgcactttgctgcgcaaaacccacttcgacaacgtgccggtgaaaccgcagcgcgtgtatgaagagatgaacaaagcctttggccgcgatgtttgttatgtcaccaccattggcctgtcacaaatcgctgcggcacaaatgctgcatgtctttaaagaccgccactggatcaactgtgggcaggcaggcccgctgggctggacgattccggcggcgctgggggtttgtgccgctgatccagagcgcaatgtggtggcgatttccggtgacttcgacttccagttcctgattgaagaattagccgttggcgcacagttcaacattccgtacatccatgtactggtcaataacgcctatctgggtctgattcgccagtcgcaacgtgcctttgatatggattactgcgtacagctcgcgttcgaaaatattaactccagcgaagtgaacggttatggcgtcgaccacgtaaaagtagcggaaggtttaggttgtaaagcaattcgcgttttcaaaccggaagatattgcaccagcctttgaacaggcgaaaatcttaatggcgcaatatcgggtaccggtagtcgtggaagttattctcgagcgtgtgaccaatatttcgatgggcagtgaactggataacgtcatggaatttgaagatatcgccgataacgccgcggacgcaccgactgaaacctgtttcatgcactatgaataagggagataaataatgttacgtttctctgctaatttatcgatgttatttggtgaatatgattttctcgcccgttttgagaaagctgcgcagtgtggttttcgcggcgttgaatttatgttcccttatgactacgacattgaagaattaaaacaggtgctggcgagtaataaactcgaacatacgctgcacaatttaccggcaggtgactgggcggcgggcgagcggggtattgcctgtattcctggccgtgaagaagagtttcgggatggcgtagcagcagcgattcgttatgctcgtgctctgggtaataaaaaaattaactgtctggtcggtaaaacgccgactggtttcagcagtgaacagattcacacaacgcttgtagaaaacctgcgttatgctgcgaatatgctgatgaaagaagatattttattactgattgaacctattaaccattttgatattcctggtttccatctcaccggaacccggcaggcactgaaactgattgacgatgttggttgctgcaatttgaaaattcagtatgacatttatcacatgcagcggatggaaggtgaattaactaataccatgactcagtgggccgataaaattggtcacctgcaaattgctgataatccgcatcgcggcgaaccgggaaccggagaaattaattacgaatatctctttacggtaattgaaaattctgactacaacggttgggttggctgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaactgcatgtcacaaccattggtccggttgctgatgaattactgtcactgggcgccgttagtgttgaaactgcgcgccaggtaacagatgcatcggacatcatttttattatggtgccggatacgccacaggttgaagacgttctgtttggtgaaaatggttgtaccaaagcctcgctgaagggcaaaaccattgttgatatgagctccatttccccgattgaaactaaacgtttcgctcgtcaggtgaatgaactgggcggcgattatctcgatgcgccagtctccggcggtgaaatcggcgcgcgtgaagggacgttatcgattatggttggcggtgatgaagcagtatttgaacgtgtaaaaccgctgtttgaactgctcggtaaaaatatcaccctcgtgggcggtaacggcgacggtcaaacctgcaaagtggcaaatcagattatcgtggcgctcaatattgaagcggtttctgaagccttgttgtttgcttcaaaagccggtgcggacccggtacgtgtgcgccaggcgctgatgggcggctttgcttcctcacggattctggaagttcacggtgagcgcatgattaaacgcacctttaatccaggtttcaaaattgcgctgcaccagaaagatctcaacctggcactgcaaagtgcgaaagcactggcgctgaacctgccaaacaccgcgacctgccaggaattgtttaatacatgtgcggcaaacggtggcagccagttggatcactctgcgttagtgcaggcgctggaattaatgggtaaccataaactggcctgatacccgcaataaaaatggccgatatcagaaaatgaatcggccagcaatattaaaaaaagaaagcagccaaagatgttgcttcagtattaaaaataatatttttattttatttgttcctcatagctagattaaaacaacgttattcgatacgtgaaattaagagggatttatggaacatcagagaaaattattccagcaacgcggctatagcgaagatctactgccgaaaacgcaaagtcagcggacctggaaaacatttaactattttaccttatggatgggttcggttcataacgttcccaattatgtgatggttggcggcttttttattctcggcttgtctacctttagtattatgctggcaattatcctcagcgcctttttcattgccgcggtaatggtattaaacggtgctgcgggcagtaaatacggcgtaccgtttgccatgatcctgcgtgcttcttacggcgtacgtggtgcactgtttcccggattattaagaggcggtattgctgccattatgtggtttggcctgcaatgttacgcggggtcactggcctgcttgattctgattggcaaaatctggccgggatttttgactctcggtggcgatttcacgctgttaggcctttctctaccgggattaattacttttttactcttctggctggttaacgttggtattggttttggcggcggaaaagttttaaataaattcactgccattcttaacccgtgcatctatatcgttttcggcggtatggcgatttgggcgatttcgctggtcgggatcggtccaatctttgactacattccgggcggtattcagaaagcagaaaacagtggcttcctgtttctggtggtgataaacgcggtggttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcattacggcgctgacacctggaacgtgctggatattgttcagcgttgggacagcctgttcgcctcgttctttgcggtactggttattctgatgacgactatctctactaacgccaccggtaatattattccggctggttatcagattgccgccattgcaccgacgaaactgacctataaaaacggcgtactgattgccagtattatcagcctgctgatctgcccgtggaaattaatggaaaatcaggacagtatttatctgttcctcgatattatcggcggaatgcttggtccggtaattggtgtgatgatggcgcattattttgtggtgatgcgtgggcaaattaatcttgatgaactgtacaccgcacctggcgattataaatattacgataacggttttaacctcaccgcgttttcagtaactctggtggccgttattttatctcttggcggtaagtttattccctttatggaaccgttatcacgtgtttcatggtttgtcggcgtcatcgtcgcctttgcggcctacgccttattaaagaaacgtacaacagcagaaaaaacaggagaacaaaaaaccataggttaattaatcacgatattgaacattgagttaaaaaccaatctgtattttacaaggagtttgttatgtcttttgatttaatcattaaaaacggcaccgttattttagaaaacgaagctcgcgttgtagatatcgccgttaaagacggaaaaattgctgctatcggccaggatctgggcgatgcaaaagacgttatggatgcgtctggtctggtggtttcgccgggcatggttgatgcgcacacccatatttctgaaccgggtcgcagccactgggaaggttatgaaaccggtactcgcgcagcagcaaaaggtggtatcaccaccatgatcgaaatgccgctcaaccagctgcctgcaacggttgaccgcgcctcaattgaactgaagttcgatgccgctaaaggaaagctgactatcgatgcggcacaactcggtggcctggtgtcttacaacattgaccgtctgcatgagttggatgaagtgggtgttgtcggtttcaaatgcttcgttgcgacctgtggcgatcgcggtatcgacaacgacttccgtgacgtcaatgactggcaattcttcaaaggcgcgcagaagctgggtgaactaggccagccggtgctggtgcactgcgaaaacgcgctgatctgtgacgcactgggcgaagaagcgaagcgtgaaggtcgcgtaactgcccatgactatgtggcttcgcgtccggtatttaccgaagtggaagcgattcgccgcgtactgtacctggcgaaagtcgctggttgccgtctgcacgtttgccacgtcagcagcccggaaggtgttgaggaagtgactcgtgcacgtcaggaaggtcaggatgttacttgtgaatcctgcccgcattactttgtgttggataccgatcagttcgaagaaatcggtactctggcgaagtgttcaccgccgatccgcgatctggaaaaccagaaaggcatgtgggaaaaactgtttaacggtgaaatagactgcctggtttccgaccactctccatgcccgccggaaatgaaagccggtaacatcatgaaagcgtggggcggtatcgctggtctgcaaagctgcatggacgtgatgttcgatgaagcggtacagaaacgcggaatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtactattggcgcgcgtatcacgaaaaccatcttacgtggtgatgtgatttacgatatcgaacagggcttccctgttgcgccgaaaggtcaatttatccttaaacatcagcagtaatctggccctgcaatgcccgtccttgtggcgggcattctccggttaaggtgtgtttatgttcaattttgcagtgggccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttctgcggtcatcgtcgcgctattatggaggggccgggcggcctgtggtggggaaccatcctgactatcacccttggcgaagcatcgcgcgggacaccgatcaacgatatcgctaccagtctggcggtggggattgcgctctccggcgtgctgacgatgttgattggttttagcggattaggccatcgcctggcacggttatttacgccgtcggtgatggtcttgtttatgttgatgctgggtgcgcaactgaccactatctttttcaaaggtatgctcgggctgccgtttggcatagccgacccgaattttaaaattcaattaccgccgttcgcgctctcggtggcggtgatgtgcctggtactggcgatgattattttcctgccacaacgttttgcccgttacggcctgctggtcggtacgataaccggctggttgttgtggtacttttgctttccttcttcgcattcgctctccggtgagttgcactggcagtggttcccgctcggcagtggcggtgctttgtcgccggggattattctgacggcggtgattacaggtctggtaaatatcagcaatacctacggtgcgattcggggcacggatgttttttatccgcagcagggcgcggggaatacgcgttatcgtcgcagctttgtggcgaccggatttatgacactgataaccgtgccgctggcagtaattccattttcaccgtttgtttcatccattggtttattaacccagacaggcgattacacgcggcgttcgtttatttatggcagcgttatttgcctgctggtggcactggttccggcactcacgcgactgttttgcagtatccctttacccgtgagtagtgcagtcatgctggtttcttatctgcctttactcttttccgcgctggtgtttagccagcaaataacctttaccgctcgcaatatttatcgactcgcattgccgttatttgtcggcatatttttaatggcattaccgcctgtgtatctgcaagaccttccattaacgctgcgtcctctgctcagtaacggcttactggtcgggattttactggctgttcttatggataatcttattccgtgggaacgcatcgaataatttgttgaaaaaggattgataatgaaaattgtcattgcgccagactcgtttaaagagagtttaagtgcagaaaaatgttgtcaggcaattaaagccgggttttcgaccatatttcccgatgcgcactatatctgtttgccgatagcggatggcggcgaagggacggtggatgcgatggtcgccgcgacgggcggcaacatcgtgacgcttgaagtctgcgggccgatgggcgaaacagtgaatgctttttatggccttaccggcgacgggaaaacggcggtgattgagatggcggcggcaagcggcctgatgctggtcgcgcctgaaaagcgtaatccgttgctggcgtcaagttttggcaccggagagctgattcgtcatgcgctggataacggcattcgccatattattctcggcattggcggcagtgcgacggtcgacggcggtatgggcatggcgcaggcgctcggtgtgcgtttccttgatgctgacggtcaggtgctggcggctaacggcggcaatttagcgcgcgtggcaagcattgagatggatgaatgcgatccgcgtctggcgaactgccatattgaagtagcatgtgatgttgataacccgctggtaggggcacgcggcgcggcggcggtgtttggtccgcaaaaaggggcaacgccggaaatggtcgaagaactggaacaggggctgcaaaattacgcccgtgttttacaacagctaactgaaatcaacgtctgccagatggcgggtggtggcgcggcgggcggtatgggcattgcggcggcggtattcctcaatgcggatattaaaccgggtattgagattgtgttgaatgcggtcaatcttgcgcaggcagtgcagggtgcagcactggtgatcaccggggaagggcgcatcgactcgcaaacggcaggcggtaaagcgccgctgggtgtggcatcggtggcgaagcagtttaatgtcccggtgattgggattgctggcgtattgggtgatggcgtggaagtggtgcaccagtacggcattgatgcggtattcagcattttgccacgtctggctcctttagccgaagtgctcgccagcggtgaaaccaatctcttcaacagtgcgcgaaatattgcctgcgccattaaaataggtcagggaattaaaaactgactattacctttaaagcggatgcgatttatatcgcatctttttttacctgaattgactacaaaaaaagccacggaataaaccgtggcaaaatccaacatagctaaaaataatcaggcgagtggtatgacttaaatctctacgtcgcggttgcaatctttcgagtaaatatagctgaacgcttcaccacgccctacgccataaccagcctgtaaagaataagcgcccataaagatgtaatcgccttttttcaccgggatccagttattgtcgaggttataaaccccctgaccggaaagaatataggcaccgtgttcctgaacgtgggtttcgatataaccgtggctggcacctggtgcaaaagagaggatatgcatgttcatatcaaaacctaactctttgggcagaaaatccagcagaataacatcgtccatgccttcataatgaatgcgttccagttcgctggcattgccagaaaccagccacggcgcatgaccttctaccggaatatagcgacgcttatataaaaagatttggctgtcttcggcctgggcgttaacaaacgtcattaaggagcctggcgggcaataaagatagccaccttcacttaaggtaaatgttttcccttcggctttggcagtgatatttccagagatcacatacaggaacgtttcaatgccttcgccaccgaagccctgttggttgccgccgttttgatgcagtgtgaccagataatcaacaaaagaggcacccagctttggcgtggagaggattgtcgcgtcacaattttcaaagcccggaataatattttttaccagaccgtctggtgttaacagtgcgaaattaccgtgtttaacaatcgcacggttagccagtaaatcttcgcggtaaccggtgacgttatttaaatatcccatttataactccttatttctgccaggcaagttgataaagcatgagtgccaacgttttgaccccttcggcaaggtcggtaatattggtgcgttccgccgggttatggctgatcccgttgatgctgggaatgaaaatcatgcaggtcggcacgcgaggcgcgaaaatttgcgcgtcgtgcccggcaccactgtgcatcacccggtaattcagtttttcgctttcacacaattctgtcagggtggcgaccagctccttattcatcggcacgggttcttcgtccatccataaatcgatatcaataccaatatccatttcatcgcaaatcgcccgcatgtcgttttctaactgttgggtgaaatcgcgcagcacggtagcatcggtatgacgacaatcaatggtgaacgtggttttacccggcactacattcaccgtattcgggcgcggctctactttgccaaaggtcagaaccagcgggtcgcccatctttttcgctttttcgacagactgatggcaaatgcgactgaaagcgtaaaccgtatcacgacgataacccatcggcgtggtgcctgcatggtttgattcaccgttcagcgtcaccgtatagcgacgttgcccgacaattgcattcaccacgccaattgactgcccattactttccagcacacagccctgttcgatatgcagttcgacaaaggctttaatatcctgacgcggagttagtggggcgttcggcagagtaaatccgcaagccttcatcgcatcgacaaaactatttcctttggcatcacagatattccgcacgtcgtcaggattcgccagcccaaaaatatttttactgccccagaaaacatacgggaagcggctgccttcttcttctgccatcgccaccacttcgaccgtacgtaacggcgcgccgtattgcgttttcagccagtcaatagccagccacgccgccagcgcaccgaattgcccgtcgaggttaccgccgttaaccacggtatcgatatgcgaaccgctcagaaccacttcctgtggatattcggtgccactcaggcgaccgtataaattccccacttcatcgaaacgtgtttccagcccgcttgctaccattctttttttaaactgctgctgggtttccagccactccggcgaataaagtaaacgggtcatcccacccgctgggtcagcgccaaaagaggaaagccagggcagcgtttcttctatagcttgacggaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggctttgcgttgtttaatatcctgatcctgtccgggataataaacctgattaaaaccgggcgcgggggtaatggtatttaattcgcgcatggtctggctaagatgttgacggaataattcgctggaggagaaaaagttcgggttaataactatatgtaattgccccaaattacgcccggcgtgtaaatcgtcatacatcgaactaacctgtcgcccgaacggtaagccgagtaagacgcctgagaggacgtcaatcatcatcatcaggccataccctttcggcccagcggcggggagcagagcatgtaccgcgaacggatcggttgttggtgcaccgtttttatcgactgcccaggtatccgggatagacatattgcgcgagcgggcgtcgagcacttttccccatgcctgtacggtagtcgccatatcaaaggtaaggatctcgtcgccttctcccggcgcggcaaaggccagtgggttagtgccgtagtaaatttccgcgccgccaaacggcaccaccattggatcggactggcacagcgaaatgccaattaatccggcgcgggctgcctgctgcacaaaataagagattgcgccgctgtgacccatccggctgataccgaccaccgcaacgcctttttgctgggcggttttgatggcatgttccatacccattttcgctgcgacctgtccggcggcattgtcggcatgtaaaattgccgagcacggtccggtttcctcaagacgaaactccggttcgcggttggtgccgccttttgaaatgcgttcggcgtagtattcaacgcgcaccgcgccatgagagtggatccctctggcatcggcgtaaaccaatacttcagccacggttgcagcgtgctcacgttttaacccagcctggcagagtttattctcgattagctggtggagtgtttcccgactgattttcatctgtcttcctttttaacgacggtgtgaagcatgactgcaattaacatacagggaaaatatctggattatgtgatccagacaggcaaaaaaatatagttagaatttatttgataatcttcgtgcttttaacctggtttttaaaacaaccatgcttattaaaaaataacgcgtaatagtctggcggttatttgaattcttttgttaataattcccgtgtgatattcatcaccttatttactcgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagatactacaggtttctggcatgacgattttaataacgccacgccgaacgatatttgcgtggcaattcgtagcgaagcggcggatgcggggatcgcgcaggcggttatgcagcagcttgaagaggcgctaaaacaactggcgcagggttcaggcagcagccaggcgttgacgcaggtgcgtcgctgggacagtgcctgtcagaaattacccgatgccaatctggcgctgatttcagtggctggtgagtatgcggcggagctggcgaaccaggcgctggatcgcaacctcaacgtgatgatgttttccgataacgtcacgctggaagatgaaatccaacttaaaacccgcgcgcgggaaaaaggcttgctggtgatggggccagactgcggtacgtcgatgattgccgccacgccgctggcttttgctaacgtgatgccggaaggcaacattggcgtcataggcgcttccggtaccgggattcaggagctgtgctcacagattgcgctggcaggggagggaattactcacgcgattggtcttggcgggcgcgatctcagccgtgaagtgggcggcatcagtgcgctaacggcgctggaaatgctcagtgcagacgagaaaagcgaagtgctggcatttgtttcaaaaccacctgccgaaactgtgcgtctgaaaattgttaatgccatgaaagcaactggcaaaccgacggtggcgctgtttttaggttataccccggcggtggcccgcgacgagaatgtctggtttgcctcctcgctggatgaggccgctcgtctggcttgtctgctttcacgcgtcactgcgcgacgtaacgcgatagcgcctgtcagcagcggatttatttgcggtttgtataccggcggtacgctggctgctgaagcggcgggattacttgccggacaccttggcgtggaagccgacgatacccatcaacatggcatgatgctggacgccgacggacatcagatcctcgacctgggcgatgatttttacaccgtcgggcgtccccatccgatgatcgacccgaccttacgcaacctgttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgttcagacaatcaaccactgtatgccattgccacggtgacaggcactgaacgtgacccgcaatgccgctcgcagcaaatcgccacgctggaagatgcggggatcgcggtagtgagttcgctgccggaagccaccttgctggcggcggcgttaattcatccgctctcgcctgccacacagcaacacacaccgtcattactggaaaacgtcgccgtgattaacatcggattacgcagctttgcgctggagctacaaagcgccagcaaaccggttgtgcattaccaatggtcgccaatcgccggcggcaataaaaaactggctcgtttattagaacgtttgcaataaggggttcccatgtttacatcagtggcgcaagccaatgctgcggttatcgaacaaattcgtcgcgctcgtccacactggctggatgtgcaaccggcttcttcacttatcagcgaactaaacaagggcaaaacactgcttcacgccgggccgccaatgcgctggcaggagatgaccggacccatgaaaggggcgtgcgtgggcgcatgtctgttcgaaggctgggcgaaagatgaagcgcaggcgctggcaatactggagcagggggaagtgaacttcattccttgtcaccatgtgaatgccgtcgggccaatgggtggcattacttctgccagtatgccgatgctggtggtcgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcacggcaatgatggcgcagggcattaccatgggcgatgagttccatcaacgcaatattgcttcctctgcactgttaatgcgtgcgctggccccacaaattgctcgcctcgatcatgataaacagcacatcgccgaagtgatggatttcctcagcgtgaccgatcagttcttcctcaatctcgcgatggcctactgcaaggcggcgatggatgcaggcgcgatgatccgcgcaggcagcatcgttacggctatgacccgcaacggcaatatgttcgggattcgggtaagcgggctgggtgaacgctggtttactgcgcctgtaaacactccccaaggtctgtttttcaccggcttctcgcaggatcaggcgaacccggatatgggcgacagcgcgattaccgaaacctttggtattggcggagcggcaatgatcgcagcgcctggcgtaacgcgctttgtcggtgcgggtggcatggaagcggccagagcggtatctgaagagatggcggaaatttaccttgaacgcaatatgcaattgcagatccccggctgggatttccagggggcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatggggattggttgaggaacgcacaatgacgatcatccatcctctacttgccagccgtagcgcaccgaattatcgccagtcctggcggttagcgggagtgtggcggcgggcgattaacctgatgacggaaagcggcgaactgttaacgctgcatcgtcaggggagtggtttcggccccggcggatgggtgcttcgccgcgcgcaattcgatgcgttatgcggtggattatgcggcaatgaacgaccacaggttgtggcacaagggattcgcctcgggcgtttcacggttaaacagccacagcgttattgtttgctacgtattacgccgcctgcgcatcctcaagcgcttgccgttgcatggatgcaacgcgcggaggaaaccgggcttttcgggccactggcattggcggcaagcgatcagctgcctgctgaattacgccagtttcgtcactgttttcaggccgcgctcaatggcgttaagaccgactggcggcactggctgggtaaaggccccggattaacgccaagtcatgatgacacgctgagcggaatgctgctggcggcctggtattatggggctttagatgcgcgctccggtcgcccgttttttgcctgttccgacaatcttcaactcgttaccactgcggtgagcgtcagttatttacgttatgccgcgcaaggatatttcgcctcgccactcctgcactttgttcatgctctgagttgcccgaaacgtaccgcagcggcgatcgattcgctgctggcgctggggcatacgtcaggggtcgatacgctgctggggttctggcttggccaacaattattacaaggaaaaccatgaaaacactggttgtggctcttgggggcaacgccttactccagcgcggtgaggcgctgacggcaaaaaatcaatatcgcaatattgccagtgctgtacccgcgctggcgcgcctggcccgttcttatcggctggcgattgttcacggcaacggaccgcaggtggggctgctggcgttacagaatctggcgtggaaagaggtagaaccgtatccgctggatatactggtggcggaaagccaggggatgattggctatatgctggcgcagagcttgagcgcacagccgcagatgccgcctgtcacgacggtgctgacgcgcattgaggtttcgcctgatgatccggcgtttttgcagccagagaagtttattggtccggtttatcagccagaagaacaagaggcactggaagcggcttacggctggcagatgaaacgtgatggtaaatatttacgccgggtggtggcgtctccgcaaccgcgtaaaattctcgacagcgaagccatcgagttgttgctcaaagaggggcatgtggtgatttgcagtggcggcggcggtgtgcctgtggcggaagacggggctgggagtgaagcggtgattgataaagatctcgccgctgcgttgctcgccgagcagattaatgccgatggactggtgatcctcaccgatgctgatgcggtatatgaaaactggggaacgccgcagcaacgtgccattcgccatgccacaccggatgagttagcgccatttgccaaagccgatggttcgatggggccgaaggtaacggcggtgagtggctatgtcagaagccgtggtaaacccgcgtggattggggcgttatcgcggattgaagagacgctggcgggcgaagcggggacttgtatttcgctgtagtgatgggcaccaggcaattggcacatccagcctgatgcgatgctggcgcgtcttatcaggtctacagtcggtgttggagcggtgggccggataaggcgttcacgccgcatccggcaatcggcacaccatgcctgatgcgatgctggcgcgtcttatcaggcctacagtcggtgttggagcggtgggcctgataaggcgttcacgccgcatccggcaagaaaatgagcatcaattaactgaacttgctctgcgcccacatcacgccgctggcatactccggcggcagcagtgggattaaggcttccagcgtcgcggtcagacgcgatgtgtcgctgtcggtcaaattcaaatgccccactttacggcccggacggacttctttgtcgtaccagtgcagatgcacaagcggcagtttcagccagtcataattcagatcgctaccaatcagattgatcatcaccgacggattattcactactggttgcggtaacggcagatcggtaatcgcccgcagatgtagctcaaactggctgatgctggcaccgttttgcgtccagtgaccgctgttatgcacacgcggagccagttcgttgatcagcagaccttgtggggtgacaaaacactccattgccatcacgcctacatagctcagctcctgcataatcgccgacaacatctcttcagcttgcgcctgcagctgtgcgttggcctgcgggaaagcgacgctggtgcgcaaaatgccgtcctgatgcaggttatgcgtcagcggataaaacacggtgctgccatcaaaaccgcgcgcgccaaccagcgacacttcaccagagaagtttatgccctgctcgacaatacattcgccgtagcattcagcaggtaactgttcggtttcatcggcgcgtaaacgccattgaccgcgtccgtcatagccaccagtgcggcgcttaacaatcgccagctcacctaaacgatcaaacaccgcaggccactcgctgcgttcggaaagtaactgccacggtgcggtcggcaggtggagcttatcgaaaagctgcttctgagtcagacggtcggcaataatcgggaacacatcgcggttcacaaaggccggatggcgcgccagctcgcgggttaatgcagtttccggccagcgttcgatctcagcggtaatcacgctttgttgaaaaggcaccgccgccggttcagcgtccagcccgaccggccagacagcaatgcctaacggttcgcctgcctgacgcagcatacggcctaactgcccgttaccgaggacgcaaacctgtttcatgccgcacctcgcgggtccgggttttccagcacttcatcagtttgtgctttgcgccattcattcagacgctggtgcagttctttatcatgagtcgcaagaatttgtgctgccagtaacgccgcgtttgccgcgccagctttaccaatcgccagcgtacccaccggaatgccgcgcggcatttgtacgatggagtagaggctatcgacaccgctcagtgcggcgctctgtactggcacgcccagcaccggcaccagcgttttggcggcaatcatgccaggcaggtgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagtgcaaggaaaacggttgcgtaggcggaattaaccgtcagttgttgagtttttaatttgttctgcgtgttgattatgcgctctggctgaactggcaaagaatgcccatatcaacacaatgctccatggaaaaaagcaaataccgacaatcaatataaatctttctacaaaacgttggttatgggggcgggtgagtactaaataaatgagccagaaatagactatccaggaaatgaccgccgcagctaccagtgacaatgcgccaaaatagaagccgacaagaccgaaccagctaatacacagtggcgctcctgccgtaagggcgatgccagaaatcaaaaatccgttgcagcgttgcataataatattccctgttgttatttcactcagagattattaccttgctgattttaaaaaagatatacaggttgcggtagttcggtgcttttttcagaatctgtccattcgtggtcagaaaggaaaatggattagctcaacgtcatccgccgtgactttcaccatcgaaccttctgtatgccaggcacccagtaccacgcgaaaagccgtttgctgattggcgataagttcatgcaccgccgggcgatgggtatgcccgtggatcagccattgcacttgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgaggaatagcgtttgcagccagggtttgtggactttggcgcgaaaagcctgataacccgcgtcatcggtgcacagcgtgtcgccatgcataatcaacacccgacgaccataaagttcgagcaccttttcttccggcaataacgtcatgccgctttcacgggcaaagcgtttgccgagcagaaaatcacggttgccatgaatgaaataacagggaacgccggaatcggataccgctttgatcgctgcggccatctggtgatgaagtggattgggatcgtcgtcgccgatccaggcttcaaacagatcgccaagaatatacagcgcatcggccttgcgggcctcccccgctaaaaaacgcagaaaaccggcggtgatcgccggttcttccacgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccttcaaccacttcagcaaatacgcagtagccccaaccttgcaggctttcgccagagaagttcaggaagtcgttatcaaccacgttgatgaagaactgggcagttgcagagtgcggtgcctgagtacgggccattgccagcgtaccacgggtatttttcagaccgttgttggcttcgtttttgatcggttctttggtggctttttgtttcatgcccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccggttcgggtcatatatagggtggtgttatagcataaccgcacgatcggatcatctcgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacttttgttgcttttgacgtggttgcgcgctatctgcgtttcctcggctataagctgaagtatgtgcgcaacattaccgatatcgacgacaaaatcatcaaacgcgccaatgaaaatggcgaaagctttgtggcgctggtggatcgcatgatcgccgaaatgcacaaagattttgatgctttgaacattttgcgcccggatatggagccgcgcgcgacgcaccatatcgccgaaattattgaactcactgaacaactgatcgccaaaggtcacgcttatgtggcggacaacggcgacgtgatgttcgacgtcccgaccgatccgacatatggcgtgctgtcgcgtcaggatctcgatcagctgcaggcaggcgcgcgcgttgacgtggtcgacgacaaacgcaacccgatggacttcgttctgtggaagatgtcgaaagagggcgaaccgagctggccgtctccgtggggcgcgggccgtcctggctggcacattgagtgttcggcaatgaactgcaaacagttgggtaaccactttgatatccacggcggcggttctgacctgatgttcccgcaccacgagaacgaaattgcccagtccacctgtgcgcacgatggccagtatgtgaattactggatgcactccggtatggtgatggttgaccgcgagaagatgtctaaatcgctgggtaacttcttcaccgtgcgtgacgtgctgaaatactacgatgcggaaactgtgcgttacttcctgatgtcgggtcactatcgcagccagctgaactacagcgaagagaacctgaaacaggcgcgtgcggcgctggaacgtctctatactgccttgcgcggcacagacaaaaccgttgcgcctgccggtggcgaagcgtttgaagcgcgctttattgaagcaatggacgacgatttcaacaccccggaagcctattccgtgctgtttgatatggcgcgtgaagtgaaccgtctgaaagcagaagatatggcagcggcgaatgcaatggcgtctcacctgcgtaaactttctgccgtattgggcctgctggagcaagaaccggaagcgttcctgcaaagcggtgcgcaggcagacgacagcgaagtggctgagattgaagcgttaattcaacagcgtctggatgcccgtaaagcgaaagactgggcggcggcagatgcggcgcgtgaccgccttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgactttaatcacctgccagggagcgaaaaagcgttcatctgaccacggccacagccagccaacccctttaccgccagtggttaccgaatccagcaagctgtgcgatagcaacgagacggttaaaaacagccagcagcgaatcagcccagccctgaaccatcgacgtccaatcagcacacataacagcgggacaacaaacgcaaacaccagcgaatgggtaaatccgcgatgaccaaaaacgttgccgtaagcaacgccaaatttaaacgataatacgtcggcatcaggcaacatcgccaggacgattccggcaaataacagacgcggagggatggctttcgaacccaaccctaaaccaatgcataggagaacggcggcgtgcgtaataacggttggcatgatggtcgcttcggcaaaatgccgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacaattttgcagcgtttgcgcgtttcaaccgcaccgtcgactttcacctggccttctgctatcgcgattttcgcctgcgcgccgctttcgctccagccttccagtttcagcaagtcgcacagctcaacgtgcggatgtttacctaaagaaaatgtcgccatgttactcaccctgtggatcatgatattcaacgcacgcctgtagcgtgttttcaatcagcgtggcaaccgtcatcgggccaacgccgcccggaacaggcgtaatgtatgaggcgcgtttagccgcgtcttcaaacacgacgtcgcccacaactttgccattttccagacggttgatgccgacatcaatcacaattgcgccttctttgatccagtcaccaggaataaagcccggcttgccgacggcaacgatcagtagatcggcattttctacgtggtgacgcagatttttagtgaaacggtgagtcacggtggtggtgcaacctgccagcagcagttccatgctcattgggcgaccgacgatattcgatgcgccaatcaccacggcgttaaggccgaaggtatcaatgttgtaacgctcaagcagcgtgacgataccacgcggggtgcagggacgcagacgcggcgcgcgctggcacaggcgaccgacgttataaggatggaagccgtctacgtctttgtccgggtgaatacgttccagtactttgacgttatcaatacccgccggtaacggcagttgaaccagaatgccatcaatggtgttgtcggcattcagcgcatcgataagctccagcagctccgcttcgctggtggtttccgggaggtcataagagcgggagacgaacccgacttcttcacaagccttgcgtttgcttgcgacataaatttgcgatgcagggttactgcccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtaggtcgaaggggatgtgtctattttgtcagaagcgtggcgcgctgtcagttttcgttttctgaaaagtaaaaccttctgtacctggctgattcacacctatcatgataaccgtcgttggtttgccgccatagtgagctacatcagatgcggtcgtacacttgttcagcaactggttcaaaagccattgactcagcaagggttgaccgtataattcacgcgattacagcacaccgtggtatcaatgcgcccttagctcagttggatagagcaacgaccttctaagtcgtgggccgcaggttcgaatcctgcagggcgcgccattaaaattcaatcagttacgccttctttatttcttctataattccagagtgggacattatcaccaaaaatgtcgtctattttcctcgcgtgctcagtcaaatgattaggcgcaaggtgagcatatctacgaaccatttctctggactcccatccgcccatttcctgaagcactgataatgggacgcctgacggaatcaaccagcttgcccaggtatgtctgaggtcatggaaacggaaattttcaattcctgcacgacgacaagctgatagccatgctgtcttgctgtcaatgcgcatcttcctgagcgcaggcattgatgttccatctgctcgcttagccgccctggtatgtacacccacatttgtgatgcttgcctgtttgatcatgcagcactttagaggctgtatcgttcagcgccacaccaatggcgcggtttgatttgctatcttctggattcaccctggcaacttgtcgctgcatgtcaatctgttgccactccagatttatgatgttcgactttctcagaacagttaccagcgcaaatttgacgacagatttcagtggttcggggctctcatcaatcaggcgttttgcctgattcttttgtaagtctcttgtgccattacacctcatacaggtttgcctgcaaacagtactgatattgcccagatattccggctggcttcgtggttgttttcaacagtgatgaggcatcgtggcatctcgttgaagaccatcgggggaaaacggtttatgacgtggcatcaggggacgcattatttatttctgaactcggtccgttaccggaaaatgtcacctggtatccccggcaggggagtttcagaagtggaacggcatatcatggataaaggatacggaggaagaaacctcgttgctggaagcctggaagatgtatcgggtgttgctgaaccgagttgatacatcaactgcccctgatattgagtggcctgtgaaccctgtctgagagtaatcattgggattatgccgcagcacgtcgtgcgcaagaacgtgctgcggctggatgctattttttccctgaagcggaaaacattactacagtacctttaaccttggttttaacattctcgaaatgctctgagagtatatgtgttaagccttcttcggaatcttttgtgtttgaaaagatgcctttctgattgtaaatgcgcatcagtttttgaccgaagctattgtgcacaacgccgtcaccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggatcaaaaacatcatggctaattttatgtttaatttttgattccccagcccttgtcgatgccgcgttcaggctagcttcgttcaaatccattaaagatatcagactactctcaggtacgtgagtaaggtaaaacccagttccaacgccaatatccagatggttgttacctaaatgttccagaaagtgtggaagaaggtgttcctttgtaggacatccccatgcaagccgatttgatacacccaaaacccaccagtcataaagctttagggtaagtggtgtgtaaattttagccccatcatctgtgttttttttcattagtttcaccatgttatagttttatttgtgaattaaatcaattatagcgatgaattacaaggggttaaatgatgccacggcataacgaatttaaatatattgagtcttgtgttgcggtaagaggttacacgccaggacgcaggttaaatgcttacaagattaggggatattgtttgcttttaacggtaaacaaattccccggggctatacaataccaccggggagaaaatctatttaacgttgttaaaaggtgtacttaagaccagcagtagtgatgaagttatagttttctatgcctgcaccatttttgctgtagtctgaagtgttatcattgtgatcataaagtgaagtattaccttttttattcgtaacccgattccatgcgccttcaacataaacttttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcccgatcgaccatattgccacctcggctaccgagagttgtccagccagcagccccgatagatatctggggcatcaaatcccaattaattgcacctttaataattgcagcgttattgaatttccagtcaagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaataggggttgtcaggactattcccagaagtttcgcccgcataaaaggtctccattcaatcgttttaatgattgagtatgtattttttatatctaacttaatgagtcaattgtatattgccccactgtttatattttgtttaacattgaatttttgtcacaatgcgctgtcagttttttagtttaattgtctgtttgtgttttgcattgtggttttatgggctaattatttttttctttgtggagtttttatctattcaagtgccatgcctttagatgcatattagcgataatagcatgaggtttatcctcaattgctgtgttttttagtataaaaaagaggaacaaaactgagacacataaggcctcgcaatggcttgcaaggttttacatattttgaagtggtggaacgtgtgaacgcagagatggcgcggtaatttgttgatttaaaatgtcgttcctggagtttctaagtcgtgggctacaggttcgaatcctgcagggcgagccatttcctcgccatttatttgttcccttttacaaattacaccatcactttgttgtcgcggttttgctaaataattggaacacgtcagacgaataaaatgaaaacagaaattctgctaaacaattcatcttgccaggattttgattaggaaagtgaaaaggaaaggagcaagctaagttgctccctttaatcattaatactcaaggatactctgcgcgacgggcaaatagcgcagagagaaatagagcgtgtctttaccgcaagaggaacgtttcgctaacagcgaggcaatttctgcgttcggtttcggtttcgctgtaaacgttttacctttgccggcgacaaacagttcataaacaatgccgcctgctggggcggaactttggcaatcggcgctggcctgtagataacgttcacgctgttcagcggtcagtttatccacgccgctgccatcctgtacccagacattaacaccggttgctttaacttgttccagcagttggcgatagccatctggcgacatgtttccggcgaaaaaactactgatataaaccggttttgctgaaacatcgctaatcaaccgctgcgcgttgtttaaccatgttagcaaaggctgacgggcggcttcgctgcgccagttcaggtcgtcaatttccgcgctgatgtaccagccatccggcgttacgccaggcacggcgctccataatctggcttgctggagatcggcagccagcaggcgattaagatagctttccagcgctgcggacgactgtttctggtgcataaaaaattccggatcggcgttcagcccgacaatcagcttcaggccagcctgttgcgcaactgcggcacgcttaaacaataacgcgcgctgttctggctgggtgaatgcatcgccgtaacgggtccattgcaaaaccagggtatcgaagccttgcaaacgtaactgactcatcagcccctgccactgggtatcggtaacctgactatcacggttttgtggttgccagataatacctttcatcgcaaaggaaaaagggctgaccaaaagcagtgtcagcaatacgaaaatgaacttacgcatttaccagtgcactccaatggtgagaaacgcgttgttgcgctctccgttacgttgattaatcgccttaaaggtatgttgatactcgacgccgagactgactttgtgcggccaggcgtcgtagtgcgtctcgccggtccagatattccagcggaccccgacaccgccaagctgcgcgccctgagtgcctttatcacgataaccgttgtcctgaacgtgagcgtaaggctcaatagtctgtccgttcgccaccttctgatgccagcttacgcgataatctgccgtccacgcctgaatatcctggcggacatattgcgccgcatcgaggtacaggttttgggcaaaccagcctgaaccgttcgggtgccattcgtcgctgtatttgccgccattaaagaatgaggcgctggcgcgcagcatggtatcggatgcgccattttgcccgttcagcggcaactgctgttcgacggcgaggaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgatgcggtactcggcttccagttgcccgtagctacgatagcttttccctggtgctgcgccgccgacattattgttagcggtactcattgcgccggaacgcaagccgatagaagaatcgaaactgaacgtccagcggcgaccgacctcctcatgcagacggcggaaattgaagcgttgctgattttgctctggggtcagtggggttatcagcgcctgattatcaatgtcatcaatcaccagccgggcgtagtgctgcgtcgcaggcatgtcatccagacgctggttcacgtaggccagttgtcggataagtgccggatcgtccggtagccctttatgcgcctgttcgagcatttcccgcgactgtgcgatatcaccgctatcccacaaggcgtaaccgagcgctgcctgggtgttgctattattcggttccagttccagcgcggcgcgcaaatcactcaccgccgccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgtttcccagcccacgttgttctgcctgctgaagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgtccggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggcgttgccaggtaaggatgactttccagcagagacgccagtcgcgccattaacgtctggctgacacgcgcatcgccctggaaaggatagcgttgcagcaataaatcggcagcttcgcgtgactgttcgttctgcatcagttgccaggtcagttgatccaggcgggtaagatttgccggttcttgctgatacagcaatcgtgccagacgcagagcttcagccttgttacgggtcgctacgctaacggcataacgctcctcaagcatttcattggcggggagggtggcgagcagtttttgcgctgcgccgtactgaccttcttttaacagcaccggtagcgtcgcgccaacaacatactggcggttgtcggcaaactgtaccgtataattcgccaacgcctgaacggggttgccgctgtatttagataacagatagagccaacttttctcttgtgcgtccgtggtaaatagcggcgtattttcaatgagataatgctggaggcgtgctttttcgccacgataagccagcgcggtcgcgtaagtaatatatgactgaggatcggtgaagatcccctgtgattgcagcgccaggatccgatcatccagctgcgcggcaagaagcacgtcaaaccactgacggcgttctgccgcacttaatgtgttctgctggcgtgcttcattatatagcgtatctgcctgggaccattgtttcaggtagattgcgcgttgcagcagatcggttcgcagcgtttttccttccggcgatgcagcaaacgtcgcatcgttcagttgcgctctggcgacaggtaattgtgccagccgcagggcattctgcccgacttcactgcgacaacgcagggtcggcgcagcatcgcacgctttttgctgggcaagcagttcttcaacagtcgtaacgcttttcacttcaacaggaatagccgccagactgcgctcaagccgatcatctcctgggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgccttatcgagacggggataaataacaaaatggcgataatcgctcagccccagctcttctgcgctggtgccgatattgtctgcgagtgcgctggtactcaataaagacgtcagcagtaaaccagaccatccgatgacgcgattaaggttattctccttcattttcggactccagttgtgcaacactgttcagtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttctgcgaacaggaactgatgcggcacatattgccgccagatttcaccggcctgctgttccgtgagccactgatgctgaacagcattgtacaacattgcccgcggatcgtgaccgcgtcggcgtgcataccagtggcgtaatccggtgacaatttgtccccgcagaacaatgacgtaacgcactttgcgtccgactttacgcgtcagggccgccagcgaaaccgggtcaataccatcttcactgccgacaattaactcatcattgtccagacgcagcggcagtaccgcataatgcaacgccacggaggccggcatttcggcaatcagcgaggaagggatctgccaggcatcgatggattcccacgccacgccgttttgctctgccagcgcctgtgccagttgctcggcgctaatcagcccctgcatcagcattgaaccgcccaggcgtagaccttcgacgcgattacgcagtgctgtatcgagttgttcttcagtgatgacctgattttccagcaggatttgacctaacggacgcaacgagcgggtatcgccagtcacgctggggaagtcatgcgttgttttatcccacgcgacacgacgtggatcgccgtgttgaagtacctgttttaacgcgcgccagttggccatgaagttaatcaggttgccccagaaaagacgcaggacagatagcagcccctgcgtcaggccgtagtagccagtaacgaaaatcacccgctgcacgatgcggttaatcatcaagccaaagtttagccacagcagagtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttgtgggttttaaagccctggaaaacaatgccgatgatccagcgagatttttgccgaaccgcagtcgaaaaggtatcggggaaatattcgcgcacgcagatcatgtttgacgtccgcgcatgctgtaaaaatttacgctgctcgcgttctttggcttcgtccaccaccggaaaacggacaaaaatttccgtcatacctttctctttcaggcggaagccaatgtcgtaatcttcagtcagactctgcacgtcgaaagcaataccgtcaccgtcagctaacagtgcggtcacggcgcggcggctgaaacaggtgccgacgcctgcgctgggcacctgtccggcgagggcttcacgcaccggaacatctttgccatgcagttctgaaaactcatcaatgtaggtcatgctggtgaagtgcgtccattcgcgttcgaacggatacactgggatctgaatcagatctttacgctcgaccagatagttgaacagacgcaattccatcggtgaaatcacatcttcggcgtcatgcagaataaaaccagcaaaagcgaaattggcgctacgttcaaattgggtgatggcatccagcacgttgttcagacagtcggctttgctggtggggccaggacgcgcgcagactaccttatgcacgttcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacataatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttatcattaataggtattactattgcggcatgttatttttacactggttataaaagttgccgtttgctgaaggattaagcgggtaatatgataacaaactttgtcccccgcacatctgacgttactgcaactgtgcctttatgcgcgacaacaatcgatttcactatcgccaggccaatgccgctaccttcgccttttcgctggcgggaaggatcaacgcggtagaaacggtcaaacaatcgcggtaagtgctcaggcgcaatgggcgtaccagggttttcgacggtaacttgcaccaggtgatcgaccgtctgacagcgcactacaattgtctctccggttggcgtataacgcagggcattagaaagcaggttgcttaacgcccgacgcagcatcagcggatcgcccgcaacctgacactcgtcgccaacaaaccgcagctccacgccgcgatcttctgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttccgtttgcgtaatgagattagtaataggtgtgcgaatttcgtgggcgatatccgctgagaaattggactggcgggtaaagacatcctcaatacgctcgatcatatggttgaacgacagtaccagctgttccagctcaatgggtacggtctgcgggtcaaggcgaacgtcgagatctttcgaggtgatattctggatttgacggctgacgctgcggatcggcgcgtgacctttatgtaccgccaacagcacgataaagacgatcaggatgctgattaccgatgcggtcataataagtttattcatcaaatcattgatgtaatgaagatgaaaatcgatcgaaagcgcgatgtagagcgtataaatcggtttgccgtcaaccagcgggccaaccggcaagttaatcatccgccagttgctgtgttccatatgcccgtgaccgtgccctggcatcatcatcgtcgggccggaaaggagatacacctcgccagcctgcgcgtctttatcgggtatggcgtcacgcgtaaactcgcggatatccggcgcaccgggggagtgatacaccgttttaccgtggctatctgccagggagatcaacacattggaataaccactgacgatatcttccagcgtcattaagcgtcgggtttgcgtttcgtcagggtgattaagtacccgttcaagggtggcgctaatctcctttaaatcattaatatcctgctcggcaaaatgcacttttaccgagtggatcatgatccatgcaaaggcgaaaaacgccgcgatggtggcgaggctgataaaaaaggtcagacgggttgccagcgaaaacgggcgctgaaatggcttactgaccatccggcacctctagcatgtaacccacgccgcgcacggtctgaatcaactttggctcaaagtcgttgtcgattttgccgcgcagccgcttcaccgccacatcaatggcgttggtatcgctgtcaaaattcatgtcccatacctgcgaggcgataagcgagcggggcagcacttcgccctgatggcggaggaaaaactccagcagagtaaattctttactggtcagagtgatgcgcgtgccgctgcgggtgactttgcggctgacgagatcgaccatcagatcggcaacctgaaactgactttcgataattaccgccgctccgcgccgcagtagagtgcgcacccgcgccagcagttcagcaaaagcgaacggcttcaccagatagtcatccgcccccaactccagccccttgacgcgatgttcaatggtgccaagcgcggtaagcaacagaatcggcatccccttattggcggaacgcaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcattttcctgtcaccggaaaatcagagcctggcgagtaaagttggcagcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactaccagaacgcgggctggcgcaccttttttgttgataatcaggtgaagacgctgattagcgaggcgttggtgaataaccgggatttgcgcatggcggcgctgaaagtgcaggaagcgcgggcgcaatatcgtctgaccgatgccgaccgctacccacagctcaatggcgagggcagcggcagctggagcggcaatcttaaaggcgattcagccacgacgcgggagttatcgactggccttaacgccagctttgatctcgattttttcggtcgcttaaagaacatgagcgaagccgagcgccaaaattatttagccactgaggaagctcagcgcgcggtgcatattctgttggtttctaatgtcgcgcaaagctatttcaatcagcaactggcgtatgcgcaattgcaaatagccgaagaaacgctgcgtaattatcagcagtcatatgcgtttgtcgaaaaacaactgttgaccggtagcagcaatgttctggcgctggaacaggctcgcggggtgatagaaagtacccgcagcgacatcgctaaacgtcagggggaactggcgcaggcaaataatgcattgcaactgttattgggaagctacggcaagctgccgcaagcgcagacagtaaacagcgacagcctgcaaagcgttaaattaccggcgggcttgccgtcgcaaatcttattgcagcgccctgatattatggaagctgaacacgcgttaatggcggctaatgccaatattggtgctgcgcgtgcggcatttttcccgtctatcagcctgaccagcggaatatcaaccgccagcagcgatctgtcgtcattatttaacgccagcagcgggatgtggaattttattcctaaaattgagatccccatttttaatgccggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaatcagcgcccagcagcgttatcttgcgtcgctgcaaattactttgcaacgggcgcggacattatatcagcacggcgcagtcagttatctggaagtgctggatgccgagcgttctttatttgcaacccgacaaactttacttgacctgaattatgcccgtcaggttaacgaaatttctttatataccgccttagggggcggttggcagcaataatttttaactccaggagagaataaatgaaaaaagcactgcaagtcgcaatgtttagtctgtttaccgttatgggctttaatgcccaggctaacgaacatcatcatgaaaccatgagcgaagcacaaccacaggttattagcgccactggcgtggtaaaaggtgttgatctggaaagcaaaaaaatcaccatccatcacgatccgattgctgccgtgaactggccggagatgactatgcgctttaccatcaccccgcagacgaaaatgagcgaaattaaaaccggcgataaagtagcgtttaattttgtccaacagggcaacctttctttattacaggatattaaagtcagccagtaacccaggtttaatgagatgaaaaaaatcgcgcttattatcggcagcatgatcgcgggcggtattatttctgcggcaggttttacctggtttgcaaaggaggaaccgcccgcagaaaaaacgtcgaccgcagaacgtaaagtcttattctggtacgacccgatgtatcccaatacgcggttcgataaaccagggaaatcgccgtttatggatatggatctggtgccgaaatatgccgatgaagagagttctgcgtctggtgtgcgcattgacccgactcagacgcagaatctgggggtgaaaacggcgaccgtcacgcgcgggccgctgactttttcccagagtttcccggcgaatgtcagttacaacgagtatcagtatgccattgtgcaggcccgcgccgccgggtttatcgacaaggtgtatccgcttaccgtgggcgataaagtgcaaaagggcgcgccgcttctcgacctgaccattcccgactgggtggaagcgcagagtgagtatttactgctgcgcgaaaccggcggtacggcgacccagactgaaggcattcttgagcgactgcgactggcgggaatgccggaggctgatattcgcagcctgatcgccacgcaaaaaatccagactcgctttacgctcaaagcgcccattgatggcgtgatcaccgcgtttgatctgcgcgcgggaatgaatatcgccaaagataacgtggtcgcgaaaattcagggtatggacccggtgtgggtcactgctgcgatcccggagtccatcgcctggctggtgaaagatgcctcgcagtttacgctcaccgttccggcgcgacctgataaaacactcaccatccgcaaatggacgctgctacctggcgtggatgctgcgacccgcacgctgcaactgcgtctggaagtcgacaacgccgacgaggcgctaaaaccgggcatgaacgcctggttgcaactcaataccgccagcgaaccgatgctgctcattccgtcacaggcgctgattgataccggcaacgaacagcgggtgattaccgttgatgctgacgggcgctttgtaccgaaacgcgttgccgttttccaggcatcgcaaggcgtcaccgcgttacgctctggtctggcggaaggtgaaaaggtggtttccagcggcctgttcctgattgattctgaagccaatatttctggcgcactggagcggatgcgctctgaaagtgctacccatgcgcattgagggaatagccaatgattgaatggattattcgtcgctcggtggcgaaccgttttctggtgctgatgggcgcgttgtttctgagtatctggggcacctggactatcattaacacgccagtggatgcactgccggatctttccgatgtgcaggtgattattaaaaccagctatcccggtcaggcaccgcaaatcgttgaaaatcaggtgacttatccgctaaccaccaccatgttgtcggtgcctggcgcgaagactgtgcgcggtttctcgcagtttggcgactcttatgtgtatgtcattttcgaagatggcaccgatccgtactgggcgcgctcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattgcaggactggtttctcaaatatgagctaaaaaccatccctgacgttgcggaagtggcgtcggtgggcggtgtggtgaaagagtatcaggtggttatcgatcctcagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgtgatgttgcgaaggtccaggttggcccggagatgcgccggggcattgccgaactgaacggcgaaggcgaagtggcgggcggggtggtgatcctgcgttccggcaaaaacgcccgtgaagtgatcgccgccgtgaaggacaaactggaaacgctgaaaagcagtctgccggaaggcgtggagatagttacaacatacgatcgcagtcagctcattgaccgcgccattgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcactttcagggactgaacgccaatattatgtcgttgggtggcattgcgattgccgtcggggcgatggtcgatgccgctatcgtcatgatcgagaatgcgcataaacggctggaagagtggcagcaccagcatcctgacgccacgctggataataaaacgcgctggcaggtgatcaccgatgcatctgttgaagtggggccggcgctgtttatcagtctgctgattatcacgctgtcgtttatcccgattttcaccctggaagggcaggaggggcgtctgtttggcccgctggcgttcaccaaaacctatgcgatggcgggcgcggcgctgctggcgatcgtagtgatcccgatcctgatgggctactggatccgtggcaaaattccgccagaaagcagtaacccgctcaatcgctttttgattcgtgtttatcatccgctgttgctgaaagtactgcactggccgaaaaccacgctgttggtggcagcgctttcggtgctgacggttctctggccgctcaataaagtgggcggggaatttttaccgcagatcaatgaaggcgacttgttgtatatgccatcgacgctgccggggatttccgcagcggaggcggcgagtatgctgcaaaaaaccgacaagctgattatgagcgtacctgaagtggcgcgggtatttggcaaaaccgggaaagcggaaaccgccaccgattctgctccactggagatggtagaaacgactatccagcttaagccgcaggatcagtggcggcctggcatgacgatggacaaaatcattgaggaactggataacaccgtgcgtctgccggggctggcgaatctgtgggtgccgccaattcgtaaccgtatcgatatgctctcgactggcattaaaagccctatcggcattaaagtttccggcactgtgctggcggatatcgacacgatggcggagcaaattgaagaagtggcgcgaacggtgccaggcgtggcttctgcgcttgctgagcgtctggaaggtgggcgttatatcaacgttgagattaaccgtgaaaaagccgcgcgttacggtatgacggtggcggatgtgcagttgtttgtgacttctgcggtgggcggggcgatggttggcgaaacggtggaagggattgctcgttatccaattaatctgcgttatccgcaaagctggcgcgatagcccgcaggcactgcgccagttgccgatcctcacgccgatgaagcagcaaatcactctggcggacgtggccgacgttaaagtctctaccggaccgtcgatgctgaaaaccgagaatgcgcgcccgacgagctggatttatatcgatgcccgcgatcgtgacatggtgtcggtggttcacgatctgcaaaaagcgatagctgaaaaagtgcagttaaaaccgggcaccagcgtggcattctccgggcagttcgagctactggagcgcgccaaccataagctgaaactgatggtgccgatgacgctgatgatcatcttcgtgctgttgtatctggcgttccgtcgggtgagcgaagcgttgctgattatcagcagcgtaccgtttgcgctggtgggcggcatctggttgctgtggtggatgggctttcatctttccgtggcgacgggcaccggttttattgcccttgccggggtcgccgccgaatttggtgtggtgatgctgatgtatttacgtcacgccatagaggccgagccgtcgttgaataatccgcaaacattcagcgagcagaagctggatgaggcgttatatcacggcgcggtactgcgcgtgcgcccaaaagcgatgacggtggcggtgattatcgctggtctgctgccgattctgtggggaacaggtgcagggtcagaggtgatgagccggattgccgcgccgatgattggcggcatgatcaccgcacctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgctgggtggcgcaattggtactggtctgtttcttggcattggcccggcgattcagatggcgggtccggctgtattgctgggctacggcgtcgccgggatcatcgctttcctgattatgcgccagctcggcgagatggtggtcgaagagccggtatccggttcatttgcccactttgcctataaatactggggaccgtttgcgggcttcctctctggctggaactactgggtaatgttcgtgctggtgggaatggcagagttgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgctgattaaagtgctggcaatcatcggtatgataggctttggcctgtggctgctgttttctggtcacggtggcgagaaagccagtatcgacaacctctggcgctacggtggtttcttcgccaccggctggaatgggctgattttgtcgctggcggtaattatgttctccttcggcggtctggagctgattgggattactgcggctgaagcgcgcgatccggaaaaaagcatcccgaaagcagtgaatcaggtggtgtatcgcatcctgctgttttatatcggttcactggtggttttactggcactctatccgtgggtggaagtgaaatccaacagtagcccttttgtgatgattttccataatctcgacagcaacgtggtagcttctgcgctgaacttcgtcattctggtagcatcattatcggtgtataacagcggggtttactctaacagccgcatgctgtttggcctttctgtgcagggtaatgcgccaaagtttttgactcgcgtcagccgtcgcggcgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgcctggcgcatctgcgttttcgcgcggcgatgcgacgtcaggggcgtgaaacacaatttaaggcgctgctctatccgttcggcaactatctttgcatcgccttcctcggcatgattttgctgctgatgtgcacgatggatgatatgcgcctgtcagcgattctgctgccggtgtggattgtgttcctgtttgtggcgtttaaaacattgcgtaggaaagtgaattaagctgatgtgaggctgatttgcccgatgcgcaagcttatcgggcctacaatttgtaacgattctgtaggtcggataaggcgttcacgccgcatccgacaaaatgatgtcaacaatctgaaagccgctctcatctattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttggtaaacgcatagatctcaagcggtaaaccgttatcaccaggagccagttggcgtaccattaaggtcatatctttgcgaatccgcggatgattccgcagatattcgttcagataggcacgaaaggttccaatattggtcattcggcgcaggtttaataccgactccgtagaaccttgctggcgattccactcattaatttcctgatggcggctggttaaataaggctttaacaagtgcgctttattcagccgttgcatttcgtcttcatcaagaaaacgaatactggtgacatcaatgctgatactgcgtttaatacgtcgtccgccagatgctgacatcccgctccagtttttaaaggagtcagaaaccagagaccaggtgggaatagtggtaatggtattgtcccagttacgcactttgacggtggttaacccaatatcgatcaccgcgccatccgcgccgtatttcggcatctccagccagtcgcccagtttcagcatatcgttcgcggaaagctgaatacctgccaccagaccaagaatcggatctttaaataccaacattagcacggcagccattgcaccaagaccgctgatcagaatcgctggcgactgaccaatcagcagcgagatcatcaaaatgccgaccagaatcgcgccgatcagtttaatcccctgaaaaatccctttcagcggtaactgagatgccgccgggaatttctgcgccagattcaaaatcacatccagcaacgagaagactgaaagcagcgcatacatcatgatccacaactgcgcgcaggtagtcagaatatctgccgcttcggtgcctttttgtagccagaataccgcctgaatattgacgataatcccctgcaaggtaaaagctaaacggtggaagagtttattctgggtaatgatttgcaaccaaagccgtgaactggcgatggcgcgtttttcgaaggtccgcagtaccacccagtgcaaaaaaatatgcaccacgacggcggtcagaaaaataataccgaaaatcatcaccatcgaggtggtgtgatcgatctcaatacccgctaaatcttcaacctgggatattaaatcctgcataacgtctcctttatacaacagcagcctatgatgacggctgaaacagggttatgcaaatcaggagaatctgaggggaaatagccgggcagatgcccggcaagggagaattacacttcggttaaggtaatgttttgcggcagacgagatttcggcagcgtagcgttaaaatcttcaacgctgtgatgacccaccggaacaaccaccagactggtgtagcctttctctttcagaccaaattcttcatcgaggatggcggcgtcaaaaccttcgatgggcaccgcgtccagacccagcgccgccacgcccagcaggaagttaccgacgttgagataaacctgttttgccatccactctgcatcatcatgcagatctttacggtgcatatcggcgaagaacttgcgacctttatcgttcgcggctttcgcttccggcgtggcaaagcggccatcggcatcttcctggtcaacaaccagctttagccaggcatcgtccatcgcggtttttgcacagaacaccacgacgtgcgaggcatcaagcattttacgctcgttgaacacgtaattatcggcagcggatttggcaacacgcgctttaccttcttccgtgctggcaacaataaaatgccacggctgggagttggtgctggatgggctgtattgcagtagagttttgatctgctcggcctgttccggggtaagttttttgctggcatcaaatgccttagtggaatgacgctttaaggcgacagaaatgatatccataaagactccatgtgaaagtaattttgcgtgccagcagattacaaggatcgagatgaaatggtaagcgagaaaaatgcgctattgatttacggttgagtcaggacgcagtcgtttttgatcgcgtttagccagaccatcaaccaccagattccacgaatcgttgatcagatcgcgaagtaacgcttcggagatttcctcgccgggatacaccgaaatccagtgctttttattcatgtgataccctggcttgatgcttgggtatatttgctgatttagcagggatttttgtggatcggacttcagattgataaaggggacgccgcgcagctccgacgacagcataaaaatcttgccgccaattttaaaaacatcgaactccgggccaaaaggccagcaaagctcgacaaagggtaactcaagagccaggcgtttcgccgtttcgtgcagtgattgcttatccataaatgttcctttaggcgaaggagaataagcaaagtatgccgcgaagttcggcgataatcgacgtttaatccgccagcgagaaccagcgtcgccagataaagcgtagaacaaaatactcaatagcgcccagcactaaaaaccacagacaaaacaatacagtgtaaagctggctaagatccatcagatggaacgtggtcaccagtttttgtgccagcgtcagccccagtgcgggggcgggcagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccgacttattctccggcccagatctcacaatgctttttcaccagcccaattagcgagccaccatcggcgacgaaatcacgcattagctgcgcttcattcagaccactgacgacctgacggtgcagtgcttcaattgcgctcgatgcgccaattttatgtgcagaaggggcgattttttccagtaaacgcaaggtggcttccgttagtgaccgacgatcgccagtatgcggatcggtaatgacaccttccagcccatagcgacaggcctggaaacggttgaatttatacatcaggtaatctttctcctgatgtttaaacgggcgttccgtcagtaaccagtgggcggtggcctgaattaatcccgccatatttaccgcgtggctaagggttaacggggtatccatcacccgaacttccaccgtaccaaaatgggggctggggcgaatatcccagtgcagatctttaatgctgtcgatcatcgtggtgtaactcaggcagcgaaacagggcttcaaattgttgccagttactgacccacggcattgggccattatcgggaaaggcggaaaaaatattcggtcgtgaggaggcaaaacgcgtatccgttccctgcatatatggcgacgcggcggaaagggcgataaagtgcggcacaaaccgtgacaagccgtgcagcaaataaatggcgtcatcgccactggcgcagccaacatggacatgctgaccaaaaacggtcgcctgctggatgagatagccaaagttttccagcgttcgttgatagcgttcgttatcgcatacctcctgacgctgccatttctgaaacggatgcgtgccaccgccgcaaatttccagatgatggtctgccgctgcctgcaatacgactttctgcatcgctgaaaattgcccggcagcctggttgatatcacggcaaacatccgtcgccagctccagcatactttcggttatatcgtgctttacctctccggccgtgatctgatttttaaccgtgtcaatcagcattgatgagtcctggcttaagtcatagcccggcggattaaccacctgcatttccagttcaataccgagggtaaaaggttcagaaacatgaaaatcgggtaatggcataggtttctcttatattggcgttttctattcagtatagaagtgggagcggctgggtgagatgcggaaattctggaatgtttctttttttggtgatggagaactgattgtgactgaagcaatttggctacttttgcaatgtgacaagttatggcagagctggctggcggcgaagaattttgacgattgaggcatgcagaaaaaaacgggttcagcttcagttgattaaatgagaagtccgaaacaggactcactgtataaataaacagctattttgctaaggaagggtaagataactgcgggtgcctgaagctttccggtttcaggtttactctgaggtctggaaagatgaagccccaggagatatttctattaaccctggggctacctacccaaacctgaacaatttggatggtagtcccttcttcgcatggaggcaatataaacatgctgacgaaatatgcccttgtggcagtcatagtgctgtgtttaacggtgctgggatttacgcttctggtcggagactcgctgtgtgagtttaccgtaaaggaacgtaatattgagtttaaggctgttctcgcttacgaaccgaagaagtagccgttgtgcggggagcaatccccgcatatccggttgtcaggtcagggtggtaaggcacctgctttacactttcgcccgcggtcagtgatggctgcgggcgaatcgtaccagatgttgtcaattaatcgtgttggcacagcgttatgactattttttcttttatctgccagtgcacagcaaactgctcatcctctagtcgaatgatgatctgctgtttattccagctaattatctgataatccagaaaaccttgagcggcctgtatctcacttgccttaaatgcgctctctttggcggaaaatgccagtgtcagcgccagaggaaaggctaaaccgcagtctgcaagtcgcttgtgttccgctggtgtaataatgttgtctgtcaattctcttgcggtttgtgcagagaaaatctcttcaatatcaatgccaattggttgacgggaaaccacggctaatgccgtagtcccacagtgactaatgctgccgtatacccccgcaggccacacaggttggcgtagctcgccgattgcaggcacacatttatagccatattcccgcagcgcataaattgcagcgatccgcccggctaaatgctctgttttacgtttacgtccagcgtgttgaagttgtgcgtagtgcggcagccagagtaaatcctgctcgcgaaaactcgccggatcaaactcaacaaaatgcagcgtatgtccggcaaaggggagggaggtatgcgtagttttcatgtcaaccatattagagaatgatgacaaacgcaaaactgcctgatgcgctacgcttatcaggcctacgtggtcctgcaatatattgaattggcaagatttttgtaggccggataaggcgttcacgccgcatccggcatgaactacgcgcactttgtcaacaatctgacgttagcttcagaagtgagtattaatgctcatataccacgtacgtcccggctcgttataggtatacgccccggcacctgcgatatagttggctcctgccagatcgcccgtggtctgggcattacccgcacgccacaaacgtttgtcgaacaggttgtccacgccgccggtcagactgacattcttggtcacatcccaggtcgcgctcaggccaacaatgctgtacggactgatttctttggtttccggtccaaccgctggctgacctttgtagttgtacttcttcggctgctgcttgccgtaccaggtgaaggtcgtttgcatcgacaaatcttcccgtgcctgccagctcagcgttgagttcaacgtatattccgggatgatcgacaaacggtcgcccgtggttttgttttcactcttcagcatataagtgatgttattggtccacatcaccgtttcgctaaccggtacgtttaacgatccttccagaccttcaaccaccgctttcggtacgttatcccactgatagagatcggtgccgactgcgttttgccctacagccacatagcccgcttcaatcttattgcgataatcgttacggaaccaggtcacgcccgccagccagccgtcgcgtttgaactccagaccaatctccttgttgatgctggtttctgctttcaggtcatcattaccttgcagatagcagccgcccgcgctggcatagcagccctgacctttactgtagagaatgtagtttgggttagtctggtacagactcggcgctttataggcgcgggcgatgcccattttcagcgtgaagtcatcgcctaaactttgcgatatgttcagcgccgggctccagttattgccgacaatactgtgatgatcgaaacgcagccccggcgttacgatggtgctgtcagtcagctccatattgttttcggcaaacagcgagaaaatttctgcttttgaatatgggctacggtcggtggcactcacaccatcaatagcaccgccggtattcgttccggtcagcgcctgggtgttggaacttaagtccttcatccgttgctgattccactctgtacccagcgtcagcgtttggtttacgaggaaatcaatcggcaggttaacttcgctgtgcagcatcacgtcatcaagatcgatatctacaaaatcctgtgccgctttttcgttaaatttcccttcagtaccgcccgccagaccttccggaatacgcgagttacgggtgtgttcgtactgcacccagttgctggtggtcacgccgttatcccagccaccgttccaggtcagcgagtagttctggcgatacaggcggttggtttcatcgccatatttcgagcgagtgtaagcgtcagagttggtgttctgcgtatcacccgcatacaggttaccctggcggctgtagcccgcttccagttcgagtgactgcagaggcgcgaagtcccagcgcaccacgccattaatatctttgttgatcaccccttcgcgcccggctggtaacgtcgtggcatacgttccggcacgcgcggactgatggccctggttgatatcccacgcgtcagcctgggttttgtcgaggttgccatacaagcggaagctgaattcgtcgcccagcggaccggtcaggctgaagttggtgcgtttggtggcaccttcctctttatgttctggcgcattgaaataagcatcccaggagccgtgccactcaccactgccttttttggtaatgatgttaaccacgccgcccgccgcgccgttgccataacgcgcagctgccggaccacgtagaacttcaatacgttcaatcatttcaggcggcacccaggaggtatcaccacgggtatcgcgctcgccacgccagccctgacgcacagagttacggctgcttaccggcttgccgtcaatcaaaatcagcgtgttttccggacccatgccgcgaatatcaatctggcggttattaccacgctgaccactggtggagttaccggtcaggttaacgccaggcatggtacgaatgatctccgatacatcgcgggcaaccgggtttttgcggatttcatctgcggtaatggtcgaaacgccgggagcctgcaagttttgctcggcagcggtgaccacgatggtatcgtcatgtgaaacggcattatcgcttgtttcttctgccagtactggcagagctaccccataaatccccagattgaccagcaaggccagggaatgaatcttcttgttcattgttttttcctgcatttttgccacgaattgcaactgtcgggcatggtcgccatcaacacgacgcatcccgctaccgcgaaaacctttgatcctgaaagacacgcagtgcagctgattaattaatgtccgcgcttcccacggcgcgccattacgctattgcaaatgcaaatagttatcaataatattatcaatatatttctgcaatcaataaaaaattgcacagtaaacatggggttatggtgtgacggcgttaaaagtaggaagtgagagctggtggcagtcgaaacatggcccggaatggcaacgtctgaatgacgaaatgtttgaggtcactttctggtggcgtgatccccagggttctgaagaatactcgacgataaagcgcgtatgggtctatatcactggcgtgaccgatcaccatcagaacagccagccccggtcgatgcagcgaattgcaggaaccgatgtttggcagtggacgacacaactcaatgccaactggcgtggcagctactgctttattcctactgaacgcgatgacattttttctgcaccatcccccgatcgcctcgaattacgcgaaggctggcgaaaactattaccccaggcgatagccgatccgctgaatccacaaagctggaaaggcgggcgagggcacgctgtttctgcactcgaaatgccgcaagcgtctctgcaaccgggatgggattgtccgcaagcgccagaaacgcctgccaaagaaattatctggaaaagtgaacggttgaaaaattcacgccgtgtatggatttttaccaccggcgatgcaacagcagaagaacgcccgctggcagttttgcttgatggcgaattttgggcgcagagtatgcccgtctggcctgcgctgacttcgctgacccatcgtcggcaacttccgcccgccgtgtatgtgttgatcgacgctatcgacaccacgcaccgcgcccacgagctgccgtgtaatgcggatttctggctggcagtacagcaagagttattaccccaggtgaaagctattgccccttttagcgatcgcgccgatcgcaccgtggtcgccggacagagttttggtgggctttccgcgctgtatgccggactgcactggcctgaacgctttggctgtgtattaagccagtcaggttcgtactggtggccgcatcggggcgggcaccaagagggcatgttacttgaacagctaaaaactggtgaagttagcgccgaaggtctgcgcattgtgctggaagcgggtgttcgcgagccgatgatcatgcaggccaatcaggcgctgtatgcgcaattacaccccctaaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccacagggagcgttttacattttgcgcaatgcgcaggggcaattcagtctgtggccgcaacaatgcgccttaccggcaggctgggacgttgtgtgtcagccgcagtcacaggcgtcctgccagcagtggctggaagcccactggcgtactctgacaccggcgaatttcacccagttgcaggaggcacaatgagccagcatttacctttggtcgccgcacagcccggcatctggatggcagaaaaactgtcggatttaccctccgcctggagcgtggcgcattacgttgagttaaccggagaggttgatgcgccactactggcccgcgcggtggttgccggactagcgcaagcagatacgttgcggatgcgttttacggaagataacggcgaagtctggcagtgggtcgatgatgcgcagacgttcgaactgccagaaattatcgacctgcgaaccaacattgatccgcacggtactgcgcgggcattaatgcaggcggatttgcaacaagatctgcgcgtcgatagtggtaaaccactggtctttcatcaactgatacaggtggcggataaccgctggtactggtatcagcgttatcaccatttgctggtcgatggcttcagtttcccggccattacacgccagatcgccaacatttactgcgcattgctgcgtggcgaaccaacgcctgcttcgccgtttacgcctttcgctgatgtagtggaagagtatcagcagtaccgcgaaagtgaagcctggcagcgtgatgcggcattctgggcggaacagcgtcgtcaactaccaccgcccgcgtcactttctccggcacctttaccggggcgcagcgcttcggcagatattttgcgcctgaaactggaatttaccaacggggaattccgccagctggctacgcaactttcaggtgtgcagcgtaccgatttagcccttgcgttggcagccttgtggctggggcgattgtgcaaccgcatggactacgctgccggatttatctttatgcgtcgattgggctcggcggcgctgacggctaccggacccgtgctcaacgttttgccattaggtattcacattgcggcgcaagaaacgctaccagaactggcaacccgactggcggctcaactgaaaaaaatgcgtcgccatcaacgttacgatgccgaacaaattgtccgtgacagcgggcgagcggcaggagaggaaccgctgttcggtccggtactcaatatcaaggtatttgattaccaactggatattcctggtgttcaggcgcaaacccataccctggcaaccggtccggttaatgaccttgaactggccctgttcccggatgaacacggtgatttgagtattgagatcctcgccaataaacagcgttacgatgagccaacgttaattcaacacgctgaacgcctgaaaatgctgattgcgcagttcgctgcggctccgtcgctgttgtgcggcgatgtcgatattatgctgccaggtgagtatgcgcagctggcgcagatcaacgccactcaggttgagattccagaaaccacgctgagcgcgctggtggcagaacaagcggcaaaaacaccggatgctccggcgctggcagatgcgcgttaccagttcagctatcgggaaatgcgcgagcaggtggtggcgctggcgaatctgctgcgtgagcgcggcgttaaaccgggcgacagcgtggcggtggctctaccgcgctcggtctttttgaccctggcgctacatgcgatagttgaagctggtgcggcctggctaccgttggataccggctatccggacgatcgcctgaaaatgatgctggaagatgcgcgtccgtcgctgttaatcaccactgacgatcaactgccgcgctttagcgatatccctaatttaaccagcctttgctataacgccccgcttaccccacagggcagtgcgccgctgcagctttcacaaccgcaccacacggcttatatcatcttcacctccggttccaccggcagaccaaaaggggtaatggtcgggcagacggctatcgttaatcgcctgctttggatgcaaaaccactacccgcttacaggcgaagatgttgttgcccaaaaaacgccgtgcagttttgatgtctcggtgtgggagtttttctggccgtttattgccggggcgaaactggtgatggctgaaccggaagcgcaccgcgacccgctcgctatgcagcatttttttgctgattatggcgtaacgaccacgcactttgtgccgtcgatgctggcggcatttgttgcatcgctgacgccgcaaaccgctcgccagagttgcgcgacgttgaaacaggttttctgtagtggtgaagccttaccggctgatttatgccgcgaatggcaacagttaaccggcgcgccgttgcataatctatatggcccgacggaagcggcggtagatgtcagttggtatccggcttttggcgaggaactggcagaggtgcgcggcagcagtgtgccgattggttatccggtgtggaatacgggcctgcgcattctcgatgcgatgatgcatccggtgccgccgggtgtggcgggagatctctatctcaccggtattcaactggcgcaggggtatcttggacgacccgatctgaccgccagccgctttattgccgatccttttgccccaggtgaacggatgtaccgtaccggcgatgtggctcgctggctggataacggcgcagtggagtacctcgggcgcagtgacgatcagctaaaaattcgcgggcagcgtatcgaactgggcgaaattgatcgcgtgatgcaggcgctgccggatgtcgaacaagccgttacccacgcctgtgtgattaaccaggcggcagccactggtggtgatgcgcgtcagttggtgggctatctggtgtcgcaatcaggtctgccgttggataccagcgcattacaggcgcagcttcgtgaaacattgccaccacatatggtaccggtggttctgctgcaacttccacagttaccacttagcgccaacggcaagctggatcgcaaagccttaccgttgcctgaactgaaggcacaagcgcctgggcgtgcgccgaaagcgggcagtgaaacgattatcgccgcggcattctcgtcgttgctgggttgtgacgtgcaggatgccgatgctgatttctttgcgcttggcggtcattcgctactggcaatgaaactggcagcgcagttaagtcgacagtttgctcgtcaggtgacgccggggcaggtgatggtcgcgtcaactgtcgccaaactggcaacgattattgatggtgaagaagacagcacccagcgcatgggattcgaaaccattctgccgttgcgtgaaggtaatggtccgacgctgttttgtttccatccggcatccggttttgcctggcagttcagcgtgctctcgcgttatctcgatccacaatggtcgattatcggcattcagtcgccgcgccctcatggccccatgcagacgtcagcaaatctggatgaagtctgcgaagcgcatctggcaacgttacttgaacaacaaccgcacggcccatattacctgctgggttattcgctgggcggtacgctggcgcagggcattgcggcgcgactgcgtgcccgtggcgaacaggtggcatttcttggcttgctggatacctggccgccagaaacgcaaaactggcaggaaaaagaagccaatggtctggacccggaagtgctggcggagattaaccgcgagcgcgaagccttcctggcggcacagcagggaagtacttcaacggagttgtttaccaccattgaaggcaactacgctgatgctgtgcgcctgctgacgacagctcatagcgtaccgtttgatggtaaagcgacgctatttgttgccgaacgcacgcttcaggaaggtatgactcctgaacaggcctgggcaccgtggattgctgggctggatatctatcgtcaggattgtgcgcatgtggatattatctctccggtggcgtttgaaaaaattgggccgattattcgtgcgacgctaaataagtaaatttatattatctataaacccataattacagaaaataattatgggtttatcatttgtttaatttataagtttggtgggtatttctctgaaatagagtgaatgttgcattcagtgggagtaatttacaaacttcagcttcggataaatctcaccaactggtagagtgggggccgtggagatttactcttattggactcattttcaggttataccccatgtcatcactgaatattaaacagggaagtgaagctcattttcccgagtatcctctggcgtcgcccagtaataatgaaattgatttacttagtctaattgaagttttatggcgggccaaaaaaacggtcatggcggtcgtttttgcgtttgcctgcgcagggttactgatctctttcatcctgccgcaaaaatggaccagctcagccgtcattactcccgccgaagccattcagtggcaggacctggagaaaacctttaccaaactccgcgttcttgatctcgatattaatatcgaccgtggcggtgcatttaacctgtttatcaagaagtttcagtctgttagcttactagaagagtacctgcgctcatcaccttatgtgatggaccaattaaaagaggcgaaaatcgacgaactggatttgcatcgagctatcgtcgcattgagcgaaaaaatgaaagcggttgatgacaatgccagtaagaaaaaagatgaaccgtcactgtatacctcctggacgctaagttttaccgcgcccaccagtgaagaggcacagaaagtgttggccgggtatatcgattatatctctgcgttggtggtgaaagagtcgatagaaaacgtccgtaataaactggagatcaaaacccagtttgaaaaagcaaaactggctcaggatcgcattaaaacgaaaaatcaacttgatgcaaacattcagcgcctcaattattcactcgacattgccaacgcggcaggaattaaaaagcccgtatacagtaatggtcaggccgttaaagatgaccccgatttctctatttctctcggtgctgacggtattgaacgcaaactggaaattgaaaaagcggttactgacgttgcggaactgaacggcgaattacgtaatcgccagtatcttgttgagcagttaacaaaagcaaatatcaacgatgtgaattttacgccgtttaaatatcagttaagaccgtcattgccagtaaaaaaagacggtccgggtaagtcgattattgtgatcctttccgcgttgatcggcgggatggtggcttgtggtggtgtgctgttgcgccatgcgatggcatccagaaaacaggatgccatgatggcagaccacttagtttaaatctttgcggttgaaggtgccgttcgtccgagcggcaccacgagcggcgttccggcaaccggatcgtcaataatcatgcagcgcagaccataaatgcgctcgatcagttcagcagtgacaatctccttcggtgctccctgagcaacaattttcccttcccgcaatgcaatcaaatggctggcgtaacgacaggcctgattaagatcgtgcagcaccgccgccagggtatagcctttctcgcggttcagttcgcttaacagttccagcaaatcaatctgatgactgatatccagccaggtcgtgggttcatcgagcagcataattgccgtttcctgggccagcaccatcgcgatccacgctcgctggcgttgtccgccagaaagggtgtccacgctttgatccgccagatgagttattcccgtggcctgcatcgcttttgttaccgcgtcttcatcttctttgcgccagcgggtaaacagcggttgatgcgggtaacgcccacgcgccaccagctcctgcacggtgatatcgcccggtgtggtagcattttgcgccaacagaccaatccggcgtgcaacctctttactggcgtaatgttgaatgtgctcgccatccagccagacatgcccgtgagcaggcgtcatcaggcggcttaaggtacgcagtaacgtggatttaccgcagccatttggcccgataattgccgtgaagtgaccatcaggtatttctacagtcagattttccgcaacggtatatttgccatatccgagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccaccagcagtaacagcgccccgcacagcgccgcctgggttagcccccagcgagcggtgccactgatgcggcgggcaatgtgcggcgcgactaaagcaataaaggaaattggccccgccagggcagtggcagctgcggtaagcactacggcgaccagcatcattaacagccgcgaacgttcgacgctgacgcccagcgcacatgcggtatcatcgcccatttccagcaagcgcattcgccgcaccagcaaggcggcggcaattaacattaatataatgatgggtgcggaaggcgaggtttttgcccacgtcaggccattgagcgatccggcattccacaaacccgctgttagcgccgtttctaaagacgctttcagcaacagccaggtattaaaggccaccagcatggcgcgaacaccaataccgataataatcaaccgaaaggtgtcgataccgttacgccaggcgagcagccagaccagcagcgaagtgacaatgccgcccaccattgctgccagcgcgatagccgtcaggtcctgaccaaacagcaccatcgccaccagcacgccgctccacgccccggtgttaaagcccattacgtcagggctgccaagcgggttacgcatcagcgactgaaaaatcgcgccgctgacgcccagcgccgcgccaatcaacagcgccatcagcacgcgtggtaaacgccattcggtgaccaccatcgtcatactgcgcggcgtgtcgcccatcaacgcggcgaatacctgcgaagtttccagcgtgacggcaccgctacgtaatccccacacgcctgccatcacacaagctattagcagcagcagacaggtgataattaatcggcgagagacgtaaatcatgcgccacctcgcgttttacgtcgtacgaggaagatcagcactggtgcaccaataaaggcactgactacagaaacgcgcagttcgccgggaacaatcacccgcccaatgatatcggcaaacagcagcagggcaggggtagtgagtagcgtgacgggcagcgaccagcgatgatcggcacctaccagccagcgtgccatgtgcggcatcatcaggccaataaaggcaatcgggccaactaccgccgtcgcactaccacaaagcacggtaattgccagcagaccaatcaactgtgtgcgcgctacgcgactgcccagcgccgtcgcggtgtcactgccaaggcttaaactgttcagcgcgcggctcagtaatagcgcagttgctccagcggtaagcaccgggatcagcaccacttttaaggtatgtagattgcgaatatccagcgaaccggcttgccagaaacgcagttgatcgtagacgtcgggattaagcagggcgatgccgctggtcagcccttccagcaccgccgccagcgccacgcccgccagggttaaacgcaccggacttaactgcccgccgccctggctgccggtaaaggcaacaatcaacgaggccaccagcgccccggcgaaggccatcgccagttgctcctgcgcggaagagtaaccaaacagcgccgcgcccagcacaatggcaaaactggcaccggcgttcacgccaagcaaaccaggatcggcaagtgggtttcgggtgagggtttgcattaacgccccggcaaggccaagcgcaccgcctgccagtaaaccggcaagggtgcgcggcagacgggcgtcgagcacaatggtgcagtcggcgctctggcaggtgccggagagcgcctccagcactacggaagcggggagtgattttgctccaatgagcaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgttttatctcaattgtttctctgggtttgctcggcgtcgcggtgccggtgcagatccagatgatgacgcattccacctggcaggtggggctttcggtgacgctgaccggcggcgcgatgtttgttggcctgatggtcggcggtgtgctggcggatcgctatgagcgtaaaaaagtgattttgctggcgcgcggcacctgtggcattggcttcattggactgtgcctgaatgcgctgctgccggagccgtctttgctggcaatctatttacttggtttatgggatggttttttcgcatcacttggcgttacggcgctactggcggcgacacctgcactggtagggcgtgaaaacctaatgcaggccggggcgatcaccatgttgaccgtgcgtctggggtcggtgatttcgcccatgattggtggtttattgctggcgaccggaggcgtagcctggaactacgggctggcggcggcgggcacgtttattaccttgctaccgttgttaagccttccggcgttgccaccaccgccgcagccgcgtgagcatccgttgaaatcattactggcaggatttcgttttctactcgccagcccgctggtgggagggattgcgttgctggggggtttattgacgatggcgagcgcggtgcgggtactgtatccggcgctggctgacaactggcagatgtcggcggcgcaaattggctttctctatgcggcaatcccgctcggtgcggctattggcgcgttaaccagtggaaaactggcgcatagcgtacggccaggtctgttgatgttgctctccacattgggggcgttcctcgccattggtctgtttggcctgatgccgatgtggattttaggcgtggtttgtctggcgctgttcggctggctgagcgcggttagttcgttgctgcaatatacaatgctgcaaacgcaaaccccggaagcgatgttagggcggattaacggtttgtggacggcgcaaaacgtgacgggcgatgccataggcgcggcgctgctgggcggtttgggagcgatgatgacaccggttgcttccgcaagcgcgagcggttttggtttgttgattatcggcgtgttgttgctgctggtactagtggagttgcgacgttttcgccagacgccgccgcaggtgacagcgtccggcagttaatgcttaaaacagcgccttaagtctatccagcacttgcatggcgctgtagtaatccaggcggaacgtctcggttcccagcgcataaacctgcttgttttgtactgcaggcaggtgcgcgagcagcggattagcataaatagcatcggcgtctttctgatcaccggcgaacaggaatagtgactcgccatttaaccctgcagccagattctctccaccaagctgaatgatgtcatggcgtttgccctggctttggctggcgtttaagcctgcgggcaacttcgccagcgtaaagccgagttgttccagcatctgcccttgtgctgattccggcgtccagagattggcactgtgtgcagcggcggtatagacgatggcagtgaccggctgcggcggtaatttgatttgctctttcgccgccgccagttgcttatcaaactgtgcaatccgctctgccgcttgtttctcatgcccggtaatttcgccaagctgcgttaacagcgactgccagcttttgtcgtcgtaattgatgattaatgttggggcgatggtagaaagctgatcgtacagcgccagcgccgaatcgccgccggttgcgctaattaaaatcagatccggcatttgcgtggcaacggcttctgcactcggttcgccgatatagagccgttgcagtttgcgttctttcgccaccttgctccactggcgtaaaaagccctggtcatccgctacgcggttatttggcgtggtcgcgccgctggcgatcaccggagcatcaatcgccagcagtgagccggtcagggtgacgctggtggaaacaatacgctgcggctggctttccagggtatgagtgccacggctgtcagtaatctgacgcggccagtcggcggcctgaactgctgctattcctgaaagcaaaagtcctgttaatagaagggcgttgcggtagagcggggcgagtctcacaagtcagcttcctgttattaatgaagttaatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgttgtttgccgatgccaaagcgcagggcatcaaaaatccggtgatggtcggggcgattcccttcgatccacgtcagccttcgtcgctgtatatacctgaatcctggcagtcgttctcccgtcaggaaaaacaagcttccgcacgccgtttcactcgcagtcagtcgctgaacgtggtggaacgtcaggcaattccggaacaaaccacgtttgaacagatggttgcccgtgctgccgcacttaccgccacgccgcaggtcgacaaagtggtgttgtcacggttgattgatatcactactgacgccgccattgatagtggcgtattgctggaacggttgattgcgcaaaacccggttagttacaacttccatgttccgttggctgatggtggcgttctgctgggggccagcccggaactgctgctacgtaaagacggcgagcgttttagctccattccgttagccggttccgcgcgtcgtcagccggatgaagtgctcgatcgcgaagcgggtaatcgtctgctggcgtcagaaaaagatcgccatgaacatgaactggtgactcaggcgatgaaagaggtactgcgcaaacgcagtagtgagttacacgttccctcctctccacaattgattaccacgccgacgctgtggcatctcgcaactccctttgaaggtaaagcgaattcgcaagaaaacgcactgactttggcttgtctgctgcatccgacccccgcgctgagcggtttcccgcatcaggccgcgactcaggttattgctgaactggagccgttcgaccgcgaactgtttggcggcattgtgggttggtgtgacagcgaaggtaacggtgaatgggtggtgaccatccgctgcgcgaagctgcgggaaaatcaggtgcgtctgtttgccggagcggggattgtgcctgcgtcctcaccgttgggtgagtggcgcgaaacaggcgtcaaactttctaccatgttgaacgtttttggattgcattaaggagcgaggatgagcattccattcacccgctggccggaagagtttgcccgtcgctatcgggaaaaaggctactggcaggatttgccactgaccgacattctgactcgccacgctacgagtgacagcatcgcggttatcgacggcgagcggcagttgagttaccgggagctgaatcaggcggcggataacctcgcctgtagtttgcgccgtcagggcattaaacctggtgaaaccgcgctggtacaactgggtaacgtcgctgaactttacattacctttttcgcgctgctgaaactgggcgttgcgccggtgctggcgctgttcagccatcagcgtagtgaactgaacgcctatgccagccagattgaaccggcgttactgattgccgatcgccaacatgcgctatttagcggggatgatttcctcaacacatttgttgcagagcattcttccattcgcgtggtgcagctgctcaacgacagcggcgagcataacttgcaggatgcgattaaccatccggctgaggattttactgccacgccgtcacctgccgatgaagtggcctattttcagctttccggcggcaccaccggcacaccgaaactcatcccacgcactcacaatgactattactacagcgtgcgtcgtagcgtcgagatttgtcagttcacacaacagacgcgctacctgtgcgcgatcccggcggctcataactacgccatgagttcaccgggatcgttgggggtatttctcgctggcggcactgtcgttctggctgccgaccccagcgccacgctttgcttcccattgattgaaaaacatcaggtgaacgccaccgcgctggtgccgccagcagtcagcctgtggttgcagacactggctgaaggcgaaagccgggcgcagcttgcctcgctgaaactgttgcaggtcggcggcgcacgtctttctgccacgcttgcggcgcgtattcccgctgagattggctgccagttgcagcaggtgtttggcatggcggaagggctggtgaactacacccgacttgatgatagcgcggagaaaattatccatacccagggttacccaatgtgcccggacgatgaagtatgggttgccgatgccgaaggaaatccactgccgcaacgggaagttggacgcctgatgacgcgcgggccgtacaccttccgtggctattacaaaagcccgcagcacaatgccagcgcctttgatgccaacggtttttactgttccggcgatctgatctctattgatccagagggttacatcactgtgcaggggcgcgagaaagatcagatcaaccgtggcggcgagaagatcgctgccgaagagatcgaaaacctgctgctgcgccatccggcggtgatctacgccgcactggtgagcatggaagatgagctgatgggcgaaaaaagctgtgcttatctggtggtaaaagagccgctgcgcgcggtgcaggtgcgtcgtttcctgcgtgaacaggggattgccgaatttaaattaccggatcgcgtggagtgtgtagattcacttccgctgacggcggtcgggaaagtcgataaaaaacaattacgtcagtggctggcgtcacgcacatcagcctgaaggagagaacacgatggctattccaagattacaggcttacgcactgccggagtcccacgatattccgcacaataaagtcgactgggcctttgaaccgcaacgtgccgcgttgttaatccatgatatgcaggactattttgtcagcttctggggtgagaactgcccgatgatggagcaggtgatcgcgaatattgcggcactacgcgactactgcaaacagcacaatatcccggtttattacaccgcccagccgaaagagcagagcgatgaagatcgggcgctgttgaatgatatgtgggggcctggcctgacccgttcgccggaacagcaaaaggtggtggatcgcctgacgccagatgccgacgacacggtgctggtgaagtggcgctacagcgcgtttcatcgttccccgctggagcaaatgctcaaagagagtggacgtaaccagctgattattaccggggtatatgcccacattggctgtatgaccaccgcaacggacgcatttatgcgcgatattaaaccgtttatggtggcggatgcgctggccgatttcagccgtgacgagcatttgatgtcgctgaaatatgtggccggacgttctggtcgggtggtgatgaccgaagaattgctgccagcacctatccccgccagcaaagcggcgctgcgtgaggtgatcctgccgttgctggacgagtccgatgaacccttcgatgacgacaacctgatcgactacggtctggattcggtgcgcatgatggcgctggcggcgcgctggcgcaaagtgtatggcgatatcgactttgtcatgctggcgaaaaacccgaccatcgacgcctggtggaagctactctcccgcgaggtgaaataatggatttcagcggtaaaaatgtctgggtaactggcgcggggaaaggtatcggctatgccacggcgctggcatttgttgaggcgggggcgaaagttacaggttttgatcaagcgtttactcaggagcaatatccttttgcgaccgaagtaatggatgttgccgatgctgcgcaggtggcgcaggtatgtcagcgactgttagctgaaacggagcgactggacgtgctggtcaatgcggcgggaattttgcgcatgggcgcgaccgatcagctcagtaaagaggactggcagcagacttttgcggtcaacgtcggcggtgcatttaacctgtttcagcagaccatgaaccagtttcgccgtcagcggggcggggcgattgttactgttgcgtccgacgccgcacacacgccgcgcattggtatgagtgcttatggcgcgtcgaaagcggcgctgaaaagcctggcgttgagcgtcgggctggaactggcgggtagcggcgtgcgctgtaatgtggtttcgccgggctccaccgacaccgatatgcaacgcacgctgtgggtgagcgatgacgccgaagagcagcgtattcgcggctttggcgagcagtttaaactcggcattccgctggggaaaatcgcccgtccgcaggagattgccaatacgattttgttcctcgcctctgatctcgccagccatatcaccctacaggatattgtggtcgatggcggctcaacgctgggggcataagcatgatctggaaacgccatttaacgctcgacgagctgaacgccaccagcgataacacaatggtggcgcatctgggaattgtgtatacccgtctgggcgatgatgtgctggaagccgaaatgccggttgatacccgtactcatcagccgtttggcctgctgcatggcggcgcgtcggcggcgctggcggaaacgctgggatcgatggccggatttatgatgacccgcgacggacagtgtgtggtgggcacggaacttaacgccacacatcatcgcccggtgtctgagggaaaggtgcgcggtgtctgccaaccgctgcatcttggacgacaaaatcagagctgggaaatcgtcgttttcgatgaacaggggcggcgttgctgcacctgtcggctgggcacagcggttttgggatgaacccgacagaataaaatgagattgcaggaaaactcggttaacggagtgatcgagttaacattgttaagttaaatattggtttcaactccgatttgcatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaaaaaagtgctgttcggtcaccattttgcggccattgccggagcaggtccgttggttgggccggtactggcggcgcaaatgggttacctgccagggatgatctggctgctcgccggggtggttctcgccggtgcggtgcaggatttcatggtgctgtttgtttccacgcgccgtgacggtcgctcgctgggtgagctggtcaaagaagagatggggccaaccgccggggtgattgcgctggtggcctgctttatgatcatggtcattatccttgccgtgctggcgatgatcgtggttaaagccctgactcatagcccgtggggaacgtataccgttgcgttcaccattccgctggcgctgtttatggggatctacttgcgttatctgcgtccggggcgtattggcgaagtgtcggtgattggtctggtgttcctgattttcgccattatctctggcggctgggtggcagaaagtccgacgtgggcaccgtactttgactttaccggcgtgcagctgacctggatgctggtgggttacggttttgtggcggcggtgctgccggtgtggttgctgctggctccgcgtgactacctctcaaccttcctgaaaatcgggactatcgtcggtctggcggtgggcattttgattatgcgcccgacgctgaccatgcctgcgctaactaaatttgtcgatggcactggcccggtatggaccggtaacctgttcccgttcctgtttatcaccatcgcctgtggcgcggtgtctggcttccatgcactgatctcttccggcaccacgccgaagatgctggcgaacgaagggcaggcgtgttttatcggctacggtggaatgttaatggaatccttcgtggcgattatggcgctggtttccgcctgtatcatcgatccgggtgtgtacttcgccatgaacagcccgatggcggtgctggctccggcagggacggcggatgtggttgcttctgccgcgcaggtggtgagtagctggggctttgcgattaccccggatacgctaaaccagattgccagcgaagtgggtgaacagtcgatcatttcccgtgcgggcggagcgccgaccctggcggtggggatggcctacattctgcacggtgcgctgggcggcatgatggatgtggcgttctggtatcacttcgccattctgtttgaagcactgtttattctgacggcggtggatgcgggtacgcgtgctgcgcgctttatgttgcaggatctgctgggcgtggtgtctccgggcctgaaacggaccgattcactgcctgctaacctgctggcaacggcgctgtgcgtgctggcgtggggctacttcctgcatcagggcgtggtcgatccgctgggcggtattaacaccttgtggccgctgtttggtattgccaaccagatgctggcagggatggcgctgatgctttgtgctgtggtgctgttcaaaatgaaacgtcaacgttacgcctgggtggcgctggtaccaacggcctggctgctgatttgtaccctgaccgcaggctggcagaaagcgtttagcccggatgcgaaagtcggcttcctggcgattgctaacaagttccaggcaatgatcgacagcggcaatattccgtcgcagtatactgagtcacaactggcgcaactggtgttcaacaaccgtcttgatgccgggttaaccatcttctttatggtggtcgtggtggttctggcgctgttctcgattaagacggcactggcggcattgaaagagccgaagccaacggcgaaagaaacgccatatgagccgatgccggaaaatgtcgaggagatcgtggcgcaggcgaaaggcgcgcactaaagtcagagtgagggggaatgtgctgagcgctccccttactctcatcccgagcgtgttgatagcaattaagccctcttaattcaggagggcatttgtataccggaggtttagatgtttgattcactggcaaaagccggaaaatatttaggtcaggcggcgaaactgatgattggtatgcctgattacgacaactatgtcgaacatatgcgggttaaccatcccgatcaaacaccgatgacctacgaggagtttttccgtgagcggcaggacgcgcgctacggtggaaaaggcggtgcgcgctgctgctaaatttgtacgtcaggctttaaacgattccactttttcgaacgctgcacgcaaggtatctggtgtcagcgtgactggcaggtaatgaatggattccaccggacgtagggtgtgggcaatcattttgtcgatctccacctgattattgatatccacttccagctccgccagcgtagtcggcagatgaaaacgctgatacgccccggttaattgcgccagcacatcatcctgacccagcaaggcgctttgcaccagaattccgtaggcgactttggtgccgtggagaaacttctcggtttgtggcaaaacggtcagaccgttatgcacagcatgggccgccgccacacgcgtaaaacgatcgcccagaccaccgaccatcccaccaccagcaataatggcatccaccacatcgcaaaatgattgcgttaattgctgattttgctgatcggcaagcgcctgttcgctactgtttaacaagacgtcgcgaatggcctgcgcattattgattcccagccgcacggttagcggcaacgtttctggttgcggggccagcaccaccgcttcataccatttcgccagcgtgtcaccgatccccgccagcagatattgttgcggcgcgttgaggataatctccggttccaccagcaccataaaattggcgtcgtcgaaaatctcataatgcagcgcctgtccggcatcgttataccagacagagagcggtgtccaggcggcgcaggtagcggcgatcgtcggaacggcaacaaatggcagaccgagacggcgggcgagggctttcgcggtgtcgagtagtgcgccgccgccgacgccaatcaccacgctgcgatcgtcaccggactccgccgccagttgttgcacatcgctttcgctgcaatgaccacgaaacaaaatatgctttacccctggcagttcaaacgcaggcggcagtttggtttgtgccgcagcaatggcgcgttcgccgtagatccacactgcgcgagaaagttgttcatcagtgaaaaaatcgtgcaggtgattgaaacttccgggatgtgaaaagtagttagccgggccgacgaccacgcggataggattgtgaggcatgttgtgttgtccttattgttttatttagacatctaaacgtcttgattgccaaatactagcatcgtgttatagtgccttcaacacgcaacttcgtcaggtacaataaaaatgacaaataaccctctgattccacaaagcaaacttccacaacttggcaccactattttcacccggatgagcgcgctggcgcagcaacaccaggcgattaacctttcgcaaggctttcctgattttgatggtccgcgctatttacaggagcggctggcgtaccacgttgcccagggggcaaaccaatacgcacccatgaccggcgtgcaggccttgcgtgaggcgattgctcagaaaacggaacgtctgtatggctatcaaccggatgtcgacagcaatatcaccgtgacggcaggggcgacggaggcgttatacgcggcgataaccgcattggtgcgcaatggcgacgaagtgatttgttttgatcccagctatgacagttacgcccccgccatcgcactttcggggggaatagtgaaacgtattgcactgcaaccgccgcattttcgcgttgactggcaggaatttgccgcattgttaagcgagcgcacccgactggtgatcctcaacaccccgcataaccccagtgcaactgtctggcagcagactgatttcgccgctctgtggcaggcgatcgccgggcacgagatttttgtcattagcgatgaagtctacgagcacatcaatttttcacaacagggccatgccagcgtgctggcgcatccgcaattgtgtgagcgagcggtggcggtgtcatcgtttggcaagacctatcatatgaccggctggaaagtgggttattgcgttgcgcctgcgcccatcagcgccgagatccgcagagtgcatcagtatctgaccttttcggtgaataccccggcacaactggcgcttgccgatatgctacgtgcagaacctgagcattatcttgcgttaccggacttttatcgccagaagcgcgatattctggtgaatgccttaaatgaaagtcggctggagattttaccgtgcgaaggtacatactttttgctggtggattacagcgccgtatctacgatggatgatgttgagttttgccagtggctgacgcgggagcacggtgtagcggcgattccgctgtcggtgttttgcgccgatcccttcccacataaactgattcgtctctgttttgccaagaaggaatcgacgttgctggcagcagcagaacgcctgcgccagctgtagttatttaaccgtccaggcgcgggaaaattgacggtcggcaaacaactcttgcaggccgttaatttgcttcaggcgtaacacttcgtcgctgtccattcccagctctttgcctattttattatcgtcccatcccaactggctgagttctcggacgatttctgacatggcagtgatttggtgacgtccacgagcgcgattatgacgaatagtcgcggcgatgcgttgattacgcgtaccttccagacaggtcaccggcaaataaccttttaagcgtaattttaacgatgatgagcctttaccaatttcatggcggtgaaaaccatccacgatttccagagcatttttatccgtatgcgtgaccacaatgggttgggtaaaaccatctatttcaatggattttttcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgggttaaatcctgcgttaatcgttgttgcatagtatcccccattcctgacgttttccttttatccgttcgttataacgctgatagttcttcgctttcgtaggactaaatgataatgcccggcaccagtaatcgttattgagtaaaactttgcatattcgccgccaggaggggatatctttcgcgccaatgtccccttgctgggtttgtggaacttcgatgccttttttctgataccagtgcaaataaatggcgattttattgcggtaatgctcagccgttttttccggcatgctattgagcagcaataatgcatattcttgccagtctaaatgttctggcttgaggattttccgatgaccataaaaatgattatcatgtccggcgtaaatgccgccactttttaccccgctgactcgtgcgcacatagcagcccagcgatccggttcgataacgtgatagagccataatccttgccgttgctccgggccaaaaggttcgcaaattcgcatatgacgcagaggaacgcctgcctgatacattatattatacagtgggttacagagctgttgatggttagcataccaggtccagatatcagccactttccagtcgtagatggggtaaatgtaccagctatgaccgcctggtgcggcggtggtccagggcttatcatcggcaaaacgttgtttatttaaactggcgatggcgacaaaacggttgtaggactcatctgcacggatgccgatcatcatcgccgccggacgtttttgtgaaaaccattcagcaaactcacgcacaaattgttcgaaggtcatgccaggctggtaaaaggagaaaaagtcaggatcggttatcgcatcttgcgggggctgacgcacccattcgacatcaggttcccagcactgccattcgggttggtattgagaaagggaattttgcgtcgtaagcgggagcgcaacccagtaaaactcttcgatgacatcggcgtaaaactcacgtaatgactgaacatagttaatagtgcatgagaactgcgcttcccagtcgataaacaaaacgcagatttttttgcccatttgtcgggcaatttcagctgtcagatgcagcattaatccggaatctttaccacccgaaaaagaaacacagatacggggtagggtattaagtgtccaggtaatacgttcttttgcagcttccagaatattcagtggaagcgggattttataaatagacatctaaaaacgctctctgaacgttacggggtgactcgtgagatgaatccgctaattataggataaacgaagcaagatagagcacattattttatattcacacaatgaattaattgatgcgtaatatattatttgtcagtggtaatgaatcagaagctatcatttaaacgatctatgaatcgggagaagacaaggttgttcaacgaagccttgttataggaaatataaagtttaaccgcaggaagaggttgttccagttttatttcttttaacttcaaaaagtcacgatgtaaatcgtacagttcggtgggcacaatgcctaataagtcagtaacagaaatactattaattatagtcatcaaagaagaactgcgaaatgaaactttacggttcataaaacgttcatctatgtccatttgaatttcgtcaatccctgctgatttagatatcaatagggtgaattcttcggcgataatttgttcatagttactggtatcagtaatacgaggatgtttgttgctacatataagggaattgcgaatagtgtgtaacggcatgcagatgacagagcgactaattactggttgcagcgtaattgccaggtcagttttgcgttgaaccaacagttcttcggcattttcagctgaaagcagtatgtcatggcattctatatcgattgaagtatcttgtctaagacagcggattagcatgttgttattagtacaagaaataagctgaggaccgtagataataaaatttttctttagttcagacttattaacgatattgatcgtttgttcaaggcctctgagatttttctcaagatggtgatgcaggtttaaccctgttgtagtcggcgcgatacctttccctgagcgaatgaataacgggtcattaaattgcgcacgtaaacgttgtaacgactgactaacagcagagggcgttatatataatgattctgccgctttactaatgctgagatgttgataaatacattcaaatatgaccagtaaattgaggtcaaatttttttagatcataaagattagccataacatactccgttgtattgtctcttccataaatcattcacttgatcaataatgttgttgtatttatatgtgttatgtttttctgcttaactttggattaagattttctaaaatagcatagctgtcaggtgggttacgagcaattcatgcgtttttaggatggttgaaaagcaaggatgcatttcaaccatctatgaattatcctttatttattcctcataatgatattaagcgttttctgatcgggtaatccgacggcttgttgcagggtattttccttactcatgtaatagatagctggtgtgacatttgcccccagatcgtccatgagtttctcgttgtcgcttaacactttcatttgctctgtgcttacgtttgcaggcacgtttagcttaagcttgccaccagaggcttcatattcttgccaggtttttgcgggatctttggaggcaagaattgccgctgctgtcgccgggctttctggcttgataaccccaaccaagaatgttcttaattgcactttgccagaatctacccacgggcgagcctgctgccagaactgtttacaatatgggcagaacggatcggcgaagacgtagacaatgaccggcgcgtcttttttaccgtcgaggagccagtgggattgttccatccgttgccacatttcacgtccggcgggtgcgtaaatttctttttcgataagcgtgttactcaggttttcacctttttcgttgtacatgtaaccagagatagcgtgcttaccatctggagtcaggtagatggtgacgcccatatcctgatacttaccgagataacctttcattcctccaggggcatcgaacgttttgatgattgtaataccctgtttttcaatcgcttttactggggcaggaagttcctctgcgaaggcgattgcaggaagtagagccagtaaaagtatcttttttaacattaatttgtccttttcagtcagtgcaaaagtcgagtaaaaggcataacctatcactgtcataggtaagagcttagatcaggtgattgccctttgtttatgagggtgttgtaatccatgtcgttgttgcatttgtaagggcaacacctcagcctgcaggcaggcgctgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccattacgaagaattgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttcctttgtctttcgcgctactaactccggcgcgagatacttcggaaattcacctaattcttcgggtgctgcggcacccgattttcttccccgcaccatgatgcaagctgcatccagctagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccagggaccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgccctgacgtggtgcaggcgctgaacctgatgagcgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggtgcggaaaaacgtgcggcagaagagctgaacaagcgtgatgcttatgacgtattaatcgttggttccggcccggcgggtgcagcggcagcaatttactccgcacgtaaaggcatccgtaccggtctgatgggcgaacgttttggtggtcagatcctcgataccgttgatatcgaaaactacatttctgtaccgaagaccgaaggccagaaactggcaggtgcgctgaaagttcatgttgatgaatacgacgttgatgtgatcgacagccagagcgcgagcaaactgatcccggcagcggttgaaggcggcctgcatcagattgaaacagcttctggcgcggtactgaaagcacgcagcattatcgtggcgactggtgcaaaatggcgcaacatgaacgttcctggcgaagatcagtatcgcaccaaaggcgtgacctattgcccgcactgcgacggcccgctgtttaaaggcaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactacgcagcctgaaaaacgtcgacattattctgaatgcgcaaaccacggaagtgaaaggcgacggtagcaaagtcgtaggtctggaatatcgcgatcgtgtcagcggcaatattcacaacatcgaactggccggtattttcgtccagattggtctgctgccgaacaccaactggctggaaggcgcagtcgaacgtaatcgcatgggcgagattatcattgatgcgaaatgcgaaaccaacgtcaaaggcgtgttcgcagcgggtgactgtacgacggttccgtacaagcagatcatcatcgccactggcgaaggtgccaaagcctctctgagtgcttttgactacctgattcgcaccaaaactgcataagaagaagtaagattcacctgtaattgcttagccgccggggtcaaacctggcggcttttttattgcattaaaaagccctgcagggatggctccgggcagggcgggagacttattctggcaattaacgcacaaccagcaccggcaaattggcgtggcggatcacgctcgaggcgttagaacccaacagatgagttgaaattgatgggttacgcgaaccaatcactactacatctgcatcaagttctttcgctaactcgttaacttcatcccgcacactaccaaaacggacatgttgcttaatgcgggaaggatcgatggtgaagtggctgaccatcgtttgtaaacgttcttctgcttcatgttgcagatgctcttcaaaacgacgtacatcagcggcaaaacggtgcaggctcaggctggctgaccccggtagtacgtgaagtagatgaataactccgtcatcctgggcgaggaattcagcgtggcgaatcgctttgtcgctcaattccatttcgaaaacatccactggcatgatgattgttttgtacataagcattctctccttgtttttgcatgtatacataacagcacattattggttatgaatctataatttgcgaggctgatttgatctgaatttgctattgagctggaaaataaataaaaccaggcgttaccagcgttgttcaaggtatagcactgcagcaacaataattgctgctatgaatatataaaatgcagtgataccgagagcttcgctcatatgaggttccgcagatgaataaccagttcagattagaatgctgcgcttaagagcaaaatgataaatctggttgatatttgagcggaaagaggatgcgagtgcatcctctgggcaaagcgagttgtcgcttgtgcagatgggattaaagcaggtagtcgccagcagcttctggctggtattcgagttccagcacttcaaggtgggttgcaacgccgcccggaagttcccagtgaatggaatcgccaacgcgcagccccagcagtgcggcacctaccggagccataacggaaagctgagtattgctgtcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtactgcgagtgtcgcagataaacatacccaaaagaaaaccctcaccgtcaggcggcgagggtttaactcacatgatgatactgactgttgctcactctttgaagtgatttgcgtcacattcagggaattcctcaatgtagcgcattatgtataaatcttaatcgtcatggtttatggaagacgaattagcgtgttttgtaaatcagaggattaataacctgctttatcaatcacaaaggttttgccacagttgcctgggtgtggttgtggcaagaatgagttggcagaaagcggagcgttgatggcgtcagctttgatcgagatctgaatttcagttaaatacgcagggttaccctggcacgttagcttaactgctttcacgttctcttttccccagcttttggcaaaggcggcatcaaagtcacggcggctcactgtgttaccgtagttatccgcaaggaattttccggcttcgctctctttaatttcttgattcaggcgtaccatcgtgccgaagtatgcgtctggatcaaaaccaaagcaggcaccgtgtttggcatattcgtagcgttccaggcaggaacgtccgccagctcctggcatgacttcacttagtttagctgccgtttccagtgataacccagtttccggcgatgaacacatccggctggcgcgtgcttctggcagattcgggattgggcgagtagcgcaaccgaagcgcatccagcggcgttcatcaacaccacgggcagcaaccgatttaggcaatcctggccacagaccatgtacggtcaaaaaatcagctttgttggtcgtttcggtttgcaggcgacattcatctcgttcgttacgatttcgatcatgttgactctggcaaaatccggtttgccaggagagggccaggacatagcgatcaaaatcgccatactgttttgcctgcaacgccacggcgttggcagaagagaagggaagcagagaaaccgcgagcaacgcggcgttacgccagaatgctttcataatgggtgtggaactcatacatacactgaatattatctattaaatcataaaaaagcccgccaggtgggcttaactggcgggcgtgatgatttattcagcgtttggcgaacgtattagttccacatggcgagaatcggccagccaaccaacagcagcatagagatgtaaatcaccccgaagattgcgccaagacgccagtaatcttttgatttcacatagccacagccgtaaataatcaccccaggaccggttgcatacggcgtcagacagcccatgataccgatagacagtaccagcaggatacacagttgttccattggtacgcccggaatccctttaccgacggccagaataaccggcagcatggttgcggtgtgcgcagacaggctggcaaacaggtagtgtgcaaagtagaacaccagaaccagtacaatcaccgttgcgtttggtgagaagccttccaggtgtgtactcatcgtgttggcgaaccagtcgataaagccagaacgggtcaggccattcgccataacaaccagcgttgccaggttgaccagcgtgttccatgcgctgttatagcgagtaatgtctttccacggcacaacgtgcagcgccagcatcagcgaaactgccagcagacctaccgcagtagcattaatgacttcactgccaaatacccacaaacctaagctgagcaatacaaggccaatcagcgtccactctctgcgcgtcagcgcacccatggtttttagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttcgggaatgatttaaacagcggcggcaggtttttaatgaccggaaaaaccgtacccccggtacgcgcggtgttggacggtgtaaacggtgccagcagaatgtcgataatgacaatcgcataacccaacgtcagcgtgcgtttgcccatgaatttcaccaggaaaagggcaatacgacggcctaacccggaaacttcataccctaatgcaaaaataaatgcgccaaataccagccataccgtggtgctggaaaaaccagccagaccccatttcagcgcctgtttttgcgcattaaacgctgggtcagctaattctttggcatcaaagagcaggtaattactgccaataacgcaaatagtaaccgcaataaaactgatcgccgttgccggaattggctcgaggatcatgccgacaatcattgccacaaacactgcaaagtaatgccacgcctgcggcggcataccgtcaggtacagggataagaaacatgacacccatcaccaccaggggcgccaataatttccatatattatcttttgctaaagacatacgggttctccgaaaattaatatttccaaatttatcaagtgcttaaataattaaatctgtgctaaaaaccaggtaaggatcagcaggtcggcactgccgcctggactgagatttcgttcgatacactccctgtcgaactgccggagataatcgagatcggcgggggttcgaatgccccctttttgcaataatgtttgcgcctcgcgctgtagccagcgcaggcccccctcgccaccgcgcgatgcaacgttggtatcgccgttggtagccatcagtaggagcaaggtatcgagcaatgccagctcaggatctaacccctgatccagcagagtgaggtaatgcggcaaggcgtggttgatcaccagtggataacccgcttcggcttcaccgcgtgcgccggtaaggccaagctgctggtacaaccgttgacctgccgtcagtcgtgcattattggtacgcagttcgcgatcggtcaggccacggcagaaacttgccgccgtagaacaaacggttgttggcgttaccggctggttgagctgaagcaaacggccaattgccgcacacagtagccctaaagaaaaaatgcttcctttatgcgtgtttacgcccgcagtggcgcggaacatatcaccttcgcaagccataccaattgggcgtaatccgttgagtaccgcttccggtgccatttctgcactacaggcaccaaattcaatgaaacggggtaaccagccctgaatcgccagcgcgctgcggtggaaatcttccagcgccatatctttgtgcgcaccgcagttaatgcgatccacgaggcctggtttcggtgacaggttgacttcagtcagcatggcgcgccagcccagcagggcgtactcatcgattaatgacgtcgcaagctttgtggttttagttgacgttgcaggcatcgacatcgtttagcagcgcctccatgcggttgagtaaatcggtcagttgatgggtttttccacgcgcgcaaacagctgcgctttgctcgcacaacaggcagcggcgaggcggcagtgaataatcgcggcgggagagaatgtcgccttcgggcgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgttttgcggctaaggcacgcaaggctgtcacgccatgattaaaaattcggcgtgtgacctcgctgtctttaatcggcccaggcgcaaccacggtaaaggagaccagtggaacaggatggcgcttgagccaggcgtgttgccgtgcttgcctttcatcccggctgacgagcagctcgggaattgacaccgcatggtggctggcgagttcaggaagcaggtgcatggcttattccttcacctgatgcacaacatcgatcaccgagccatcgcggtaacgcacaacggcaacgacgcggtcggtgaattcaatcggctgtggttcaccggtcagcagacgcgcacgttcacgcagccactcaatagaaaccactttgatccccgcttcctgcagacgttctgccagctccggacgtgccgggttaacagcgatgccgtggtctgtgaccagaatatcgacactggagcccggggtgatgcaggtcagcacgttatccaccagcgtcggaatacgaccgcgtaccagcggcgcgacgatgatggaaagcgcagaagcaatcgcggtatcgcagtgaccaccggaagcaccacgcagtacgccgtcagagccggtcagcacgttaacgttgaactgggtgtcaatttccagcgcgctcagtaccaccacgtcgagacgatcaaccgctgcgcctttcgacccccagttagcgtactggttggcgctgatttcgatgtgattggggttacgggccagcgattgcgcagcatggctgtcaaagctctgcacatccagcagtttgcggatcaaacctttttcgtgcagatcaaccatcgttgcggtaataccgccgagggcgaagtcggcgcgaatatcgcggctacgcattttgtcttccaggaaacgggttaccgccagcgaagcgccgccggtgccggtctgcatggagaaaccttctttgaagtagccagagttaacaatcacatccgcagcgctacgggcaataagcagttcgcgcgggttagtggtcatacgggtagcaccagcgccgatttttgcagcatcgccaacgcgatcaactttgacgatcagatcaacctgatcttgctcaatgcttgccggattatgcggataaggcagcagttcttcggtaagcatcacgacctgttttgcgttgtcggcatcaaccattgcatagccgagggagccgcagcaggctttaccggagtagccgttggcattaccgaattcatcacaggacgggacgccgaggaaagccacatcgatattcagttcgccgctctgtaccagatgcacacgtccgccgtgagagtggatttgcaccggttccgccagcagaccacgggagatttcttccgccagtggaccgcgcaggccagaggtataaatgcgggtaaccacgccctggcgaatgtgttctaccagcggcgcatggcaatcactcagggagctggaggccagagtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcgctttttcagcctggtaggtttgctttggcgagttctggaaagcggcaagatcgcattcagcgcgacgattccaggccgctacccgttcttgtcgttgagattgttcaattttctgcgtcattttgattgccttattcttcgcggatgccggaaagttctgcacgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcaggaatccggcttcgttgttagcgtcggaatagacggtatcgaacgcctgaatacccgcagaacgcgcggcctgcaaaatggagcagcgagcgaacagcagttcagttccttccggggagcgttctgtacgcaggttgcgcacatagtcttctgcaccgagggcgataccgatcaaacgctcggaagcgtgagcgatttctaccgcgcgggtaatgcccagcggagattcaatcgccgccagcaggccggtactgccgggttcacgaccacaggctttttcgatacgcaggatctctttttcgatatccagaacatcctgagcggtatcggttttcggcagacgcacaacgtccgcaccaccgcgaacgacggcttccaggtcgttaacaccccattcggaatccagagcgtttacacgcacaatggtttcaatatcgcgataaagcggatgttgcagcgcgtggtaaaccatgcggcgggcggtgtctttttcacgcaatgcaacggagtcttcgaggtcaaacatcagggcatcagccgggtagatgaaggagttgctgaccatcgcggcattagcaccaggcacaaacaacatactgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctgttgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgtttttcgccagcagttgacgtacccgggaagcggatatcggcatctcctggtaacgcagccgctcaatttcaaccagttcgatgggcggtgcggagatagtcggcgtttccagccagtagcgcatatcctggttgtactgggcggtaacgcgacaaaagggttcagtaccgacaaagcggtgagttacacccagcgcgggagcgaggtactgacggaaaatcttcagatcaatttcggtgtaacaatggttaatgacgctctgttctttaatgaagtagcaagggaacgtagcgcgggagatgatgtattcggagccgcgatgcacagtcaggcgtggaatatcggcggtgccttttaacaccagatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcgtgctatgccgctcataggcgaggtttatcagttcagtggctaatgtcagcgccagtccttcaccgcgaacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaattgataaccttttattttcacttgggagaaaggggggcgatcgaggtatatctttttctcctttcgctatacatcctaaggagtatttcggcgtgaaattttgatttatttcacatagagttagtggttttttatttatttaatggttttaagttttttaactaatgtaattacgaaataacccgcaggtttaagtgatttaattgatttaatgaataaaatttgccacgatcatatttaatatctatgtattttgattcaacattttaattacatccgtcaaagaggctcgggacaacccgcaaggaaaacaatgttgcagcttaaagagaataaacagtttgcatttttccaaagactggcatttccgctgcgtatctttttgctgattctggtgttctcaatatttgtcattgcagccctggcgcaatattttacagccagttttgaggactatttaacgcttcatgtgcgcgacatggcaatgaatcaggcaaaaattattgcttctaatgacagtatcatcagtgcagtgaaaacgcgtgactacaagaggctggcgaccatcgctgacaaattacaaagagatactgatttcgattatgtggtgattggcgatcggcactcgattcgtctttaccatcctaatccggagaaaattggttatcctatgcagttcaccaaaccgggcgcgctggagaaaggggagagctacttcatcaccgggaaagggtcaattggcatggcgatgcgtgccaaaacgccaatctttgatgacgatggaaaagtcatcggcgtggtgtcgattggctatctggtgagtaaaatcgatagctggcgggctgagtttttattaccgatggcaggcgtgtttgtcgtgctgttagggattttgatgttgctgtcgtggttcctggccgcgcatatccgtcggcagatgatgggcatggagccaaagcaaatcgctcgcgtggtccgtcagcaagaggcgctgtttagttcggtttatgaagggctgattgcggtggatccgcacgggtacattaccgccatcaatcgtaacgcaagaaagatgctggggctgagctcccccgggcggcaatggttgggtaaacccattgctgaagtggtcaggcccgccgatttctttaccgaacagattgatgaaaaacgtcaggatgtggtggcgaactttaacggtctgagtgttattgccaaccgggaagctattcgttctggcgatgatttactgggggccattattagctttcgtagtaaagacgaaatttccaccctcaatgcgcaactgacgcaaattaaacaatacgtcgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgtgaggcgtttgccgatcgccaggtggcggggctgctttttggtaaagtgcagcgcgcccgcgaactggggctaaaaatggtcatcgtccccggtagccagctttcgcaactgccgccaggactggacagcaccgagtttgcagccattgttggcaatttacttgataacgccttcgaagcaagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggtgtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagtcagatattactggcgggaaacctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgcagccagcgatatggaaacggtgtctgaagccgtacgttgtggtgtatttgattatctcattaagcccattgcctatgaacggttggggcaaacgctaacccgtttccgccagcgtaaacatatgctggaaagtattgatagcgccagccagaagcaaattgatgagatgtttaatgcctatgctcgcggtgaacccaaagacgaactgccgaccggcattgaccccttgacgctaaacgcggtgcgaaaactgttcaaagagcctggtgtgcaacatacggcagaaacggtggcgcaggcactgaccatcagccgcaccactgccaggcgttatcttgaatattgcgccagccgccatctgattattgctgaaattgttcacggcaaagttggcagaccgcaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggcaccgaggtgcgttttacgacttcaaacggcgagatcttcgccatcccggcaaccgcaacgactacgccagaaacgggtgatagggtacgacccaggtttgacgcctgcagcatcgggatagtcaaatacgccgggttaatgccggaggagtgcgccagtttcgggatcatctcaacaaacgcataaaacggcgcattgcctgaaccggtcgtgactgccgccagcattgtcaggatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaatgcatctgccataccgcgataagccacttccagaccagagaaaactttctgggtattaaagctgcggatgaactccagaatggaggcaattagcatacaaatcaccagaatagtgatgatgtgtaattgcggaccccatttgccgtcaaaaatcagcactccgatgatcggcgtgaacggcaaaatggcataaaacgcaggggcagtggtggtgatttcactgacatctaacatttcatgagagatgtgctcttttttatccagataacgttgccagaagaagtgggcgattgccatgccgataattgcagcaattgagataggcagcgttgttttgaaggcgaagtcaatcagcgacatttcggaagcctgcgccgccagcaccacatcccctgaagtcggtgcgagaataatcgccgccggggaggcacaaatggcagcagctgcgccacgactgataccaacgtttaccatcaccggaaacagggttgccatcagcaaaacacccagaccggttgcggaagagacagccagtgacatcagacaggcaacaaaataggcggcaatcatcagaaggtaaggggagttaatatactgcaatggttttgacgccagcttgaccaccatatcattcgcgccgatatgggtcatgtaagcggcaaagccacacagcatcataatcatcatgccgaggtcgccgccgcggctcattagcaatattttaacgtattcaacgatatccgtggcgctgtagcctgttgaagcctggctggacggtaacactttgtgccccataatggcactgataatcagcaataacaggccaccgacaaataacacgccagtggcagaataccctttaatgatgtagcgagctacacccacaataaccacaaccccaataaggagttcaatgaatgtcagcataatttttcctgtctccaggccccaaagtaaataataaaaaattcctaaaagttaaggaaaaaatatgcccaataaattggcggtgaatgctgattaaaatcaagaaaaactgccattaagacattgaagttgctgtttttatacgtagataacaaaacgcatatttagcggttggcaaatatcacataataatgtgtgtaaattgatggtggattgatgcaaatttgttaattgtaaggtgttagctgcggttgtgtgctcaaaaaataatcttccatgagcatgggttgacgatacataatatattttcgttaagatattttttatatcttattaaaaaataaagtaatttttatcggttgtactttgttatcagaaacgacttggtttttcttttatgactattcccatcgcagaaaacgatgcatcgtctttaatcgatgcgcggaaatatttatcttgaactagcggaaataaatagagcagctattcatattattcttcatgttggggctattgaggttatgttaattgtagctttgctatgttagtagtagatttttgataaatgtttaatggtcacagatgaaagtgagtaaatatgtcgctatatttttctttgtttttattcagttaatcagtgttggtaaagtttttgctaacgctgatgagtggatgacaacgtttagagaaaatattgcacaaacctggcaacagccagaacattatgatttatatattcctgccatcacctggcatgcacgttttgcttacgacaaagaaaaaaccgatcgctataacgagcgaccgtggggtggcggttttggtcagtcgcgttgggatgaaaaaggaaactggcatggcctgtatgcaatggcatttaaggactcgtggaacaaatgggaaccgattgccggatacggatgggaaagtacctggcgaccgctggcggatgaaaattttcatttaggcctgggatttaccgctggcgtaacggcgcgcgataactggaattacatccctcttccggttctactgccattggcctctgtggggtatggccccgcgacgtttcagatgacctacattccgggtacctacaacaatggcaatgtgtactttgcctggatgcgctttcagttttgagacaaatgaagttttagtaaatcctttaaaatcaaccactaaaataattaacatcaaaaataacgcgacttttatcactttttagtaaagttgcactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggttttttttggtctttagtgtgcggttgaggccgaaaacagccagaaagccagtgcggtcatagcaaaagaccccaaaagattgacgaaaacgttcagtaacgcccagccaaagcggccctcttgtaacaaaaacaccacttctgccgaaaatgttgagaaggttgttagaccgccacaaaatccggtggtgattaatactttccacactggatcaatgttcgtcatcctgctgaaccaggcgaatcccattcctatgatgaatgccccaatcaggtttgctgccagcgtccccaacggaatcgcctgatgcagcgggttaaatcgcatacttaacagccatctcgccacgcttcccgtaccaccgccaataaaaactgctaaaagaagttgtaacactgcaaaatcctgctatttgatttgtatgaatgataagtgtaacgccgaataatcgccgttggcgaattttacgactctgacaggaggaggtggcaatgctggttgccgcaggacagtttgctgttacatctgtgtgggaaaagaacgctgagatttgtggctcgttgatggcgcaggcggcggaaaacgacgtttcgctgtttgtcctgccggaagcattgttggcgcgtgatgatcatgatgcagatctatcggttaaatcagcacagctgctggaaggcgaattcctcggacgtttacggcgagaaagtaaacgtaacatgatgacgacaattctgacgattcatgttccttcaacgccggggcgcgcatggaatatgctggtggcgctacaggcaggaaacatcgtcgcccgttatgccaaactgcatctctatgatgcatttgccattcaggaatcacgccatgttgatgctggtaatgaaatagctccgttactggaggtggaagggatgaaggtcggtctgatgacctgttatgacttacgctttccagagctggcgctggcacaggcattacagggagctgaaatcctggtacttcctgccgcctgggttcgtgggccgctcaaagagcatcactggtcaacgttgcttgccgctcgtgcgctggataccacctgttatatggtggcggcgggggagtgcgggaataaaaatatcgggcaaagccggattatagatccctttggcgtcaccattgcggcagcgtcagaaatgcctgcactcattatggcggaagtgacgcccgaacgtgtgcgtcaggtacgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtgacgtggcgagcaggacgctccctcaatatcttgttcgatacaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttagcatcgtcacaccatgacggcgcaggtcgcgcattacctcaataatttcttcattggtttcacccagtcccaccatcagaccagacttggtcgggatttccggatgcgcttctttaaagcgttccagcagcttaagcgaccagttgtaatctgcgccaggccgtacctgacggtaaatacgcggtacgttttccaggttatggttgaacacatctggtggcgttgcagtcagaatatccagagcacgatccatacgaccgcggaaatccggcaccagagtttcaattttgatttgcgggcttttttcccgaatggcagtaatgcaatccgcaaagtgctgggcaccgccatcgcgcagatcatcacggtcaacggaggtgataaccacataacgcagcgccatatcggcaattgtctgcgccagtttcactggttcattggcatcaggagctaccgggcgaccgtgggcaacgtcacagaacgggcaacggcgggtacaaatagcgccgaggatcataaacgttgctgtgccgtggttaaagcattccgccaggttagggcaggaggcttcctcgcagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattacgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctatggtcctgtgcaaaacatgttatcggtgatgagatcggtttgaaactgactgagttggttttccgcgccgccgatgggcaggttgcgcagtaaaagctgtggatagtgagttttaatcgcccgatagatgacaggaaggaccagggctccgaccgagggggggcagattaagcactttcgctgcattaacgattcctttatggacatatgcaacttcaaaatagtcagaagagtaagatcaatatttcgtaaggttgtaaatatttgtggtttaccttctgacgattttctacttaaacagggttcaatttgattattactatccacgcacttactcaaattttattcatggaaaaataatatttataaaaattacaataatcttatgtctaattgggacggaacgcttttgctcaccatggtaattatttcaatgagttaaccaattgggtgagctacggagcaaggcgtagcatcgcatttctgcaagtgataaagaaaatatacaaacgcgaaggagatgtaaagcattagcaggtattatgagtaatgacccagtgtaaattgggccattgatgtatggaattaagcggtaatatattcgaagtcaggattgtttagtagcgctaaaatattttccagtaaacgtggtgcaatattattagttgtcgcttcgggtttccattgtgatattttagccatttccattcctgcatacccacaaggattaatacgtaaaaatggtgaaagatccatattgacgtttaatgccagaccgtggaatgaacaaccgcgtcgaatacgtaaacccagtgagcaaattttcttttccccgacatagacaccaggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatgtgctccgcctttcctgcctgcccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcgtctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagttttttactgatgcttagtatatggggacggaaattacactttcaagtgttcaattttcaaccaaaccagtgatggaacattaatttaatgtaatcaatgattttgccgaagaagttaccttccgggatttcttgcagcacaaccagcgggcgttgttcgatcgttttgccatcaagctggaagttgatagttccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcgaagaaacggaagccccaggttagcaattttttactttcggcttcacggcctttaaaagtacgtccgcccatcaccgcagagatcaagcgcatctggccttcagtcgcagaagcaacaaggttgtaacctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaacgcctggccgatcagcgccatatctcgcgcggagctgtactgaccatcagcatccagaccgtgtaccgtctggaagtgggtatttttcaggcccagggcgttaacgtagctgttcatcaagccaacaaaagcgtcctggctaccagcggcaaaatcggccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcctggccgataacgtaactggtcatcattttggtcaggctggcaggatcgcggcggacatcagcgttctgttcggcgagtactttgccggagttgtagtcaatcaggatgtaggactccgcgtcgatctgcggtacacccgggatcatggttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaaagtgccctactatagcaaatgcactaccggcaggcatctgactttccgcgtgactttgttaacgtcatttacagaaattgacacatcagatgcctgctttacgctactgcgcggtggtaataaatgactgtaattgggcttcggtttgcaaacgttgctgcaaggtactggcttcggctttgctggcgaatgggccaagctggatccgccagaccgcgccattttgagttacgcgaccggggacgccgaacttctgtcccagttgctgttggtactgttgcgcacgagcctgatcgctaacggccccgacttgcaccataaagttgccgctggcgctttgcgaggcggcttgcggtgtcaccattgcaggtgaggttgcaggcgttgtcgacggagctgtaacaacgggctgtggcgcaggcgtcggttcgctgccttccagtacaccaggcgctaaggtcgttggtgcgccgaggaaaccgctgctggttaccggcgcgccggtcggatcttcgctttttagcgtcgaattactgaccggaagaatgtcaccctgcgggacaggcactgaacttgttcccgcgccaccgcttaaatcgggaggtgctggcagggcgtaagtctgtttggcgactgtggtacaagccataccaggaccagaaagcgaaccatcctgggcgacaataatcggatcgatacgaactttggtgttgtttgacgtgttaagacggtcagctgccgcgcgagaaagcgaaatcacgcggtcgttgccataagggccgcgatcattaatgcgcaccacgatcattcgcccgttagccaggttagtgattctggcgtagctggggattggaagcgttggatgggccgccgtcaactgtgtcggatcgaaagcttcgccagaggccgtcaggttactgccgggttcggcatcatagattgccgccagtcccgcctggctaaatcgagacggatcctgcacgattttgtagcttttaccgtcgcgctggtaatcctgatttgccgtcgcgttcagtggttcgaaacgcgggtctgccccgctaatttcaactatggggccgttacataccgcaggctgcggtacacttaccgtctgttgctgaccatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccgccagccatgacgcgaccaaaggtggtttgcgctctggcggctatccacagcccgcgcatgatcagcagaatgtaaagagcgagcagaatcaaaatgcccactaatcccagctcttccgccagtaccgcgaagataaagtcggtatggcgttcggggagaaattcaagctgtgactgagtgccgtgcagccagcctttgccgcgtaatccgccggagccaatagcaattttagactgaataatgtgatagcctgcgccgagtgggtctgattccgggtccaggagcatcattacgcgctggcgctggtaatcatgcatcaggaagaaccacagaatcggaatgaacgccgctaccagcactactgcgacgccaatcagacgccagctaaggccagagaggaacagtacaaacaggccggaaagcgcaacgaggattgatgttcccaggtcaggctgtgcagccaccagcagcgtgggcataaatatcagcaccagcgcgatagctgtattcttcaatgaaggtgggcaaacgtcgcggttgataaagcgtgcaaccatcaacggtacggctatcttggcaatttccgacggttgaaaacgaacaataccgaggtccagccagcgttgagcgcctttagagatggcaccgaaagcatctaccgccaccagcaaaataatacagatgatatagagatagggggcccagccttcataaacgcgtggaggaatttgcgccatcaccaccatgatgaccagacccatcgcaatctggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagcgtaccaaccgccggacccgcgccgccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctggcaaaatatttatgcgccgtaccgttagggcggttagcaacaccgtacataccgtctttcgccagctcccagtaaccggaatgaatatcgccgacgggcggttcatgcggttgtacccatggcacctgtttgccgtcttcggcggtgctcatcagcaaatgcggaaccttcacgataccgtcattaatcaggatcatcagtgccttactcatctggattggggtcgctgtccagtaaccctgaccgataccaaccggaatggtgtcaccctgataccacggttttttaaagcgtttttgtttccattcgcgggttggcatgttaccggaacgttcttccgccaggtcgataccggtgtaatgaccataaccgaatttccccatccattcggagaggcgatcgatccccatatcgtaggccacctgatagaagaaggtatccgcagattcttccagcgatcttgtgacattcagacgcccgtggccccattttttccagtcacgataacgtttttccgaacctggaagttgccaccagccggggtcaaacagcgtcgtattgcgcgtgatcaccccggcactcaatgccgaaaccgcaacatagggtttaactgtagacgcgggaggataaaccccctgtgtggcgcggttcaccaacggtgtattcgggtcgttcagcaaggcggaataatctttgctggagataccgtcaacaaacaggtttgggtcataactaggcgtggaaaccagcgccaacaccccacctgtacgcggatcggtgactaccacagctgcgcggctacccgccagcagcgtttcaatatattgctggagtttgagatccagcgtcaggtaaatatcgtgtccggcttgcggtggtacttcttttaactggcggataacacgcccacggttgttaacttcaacctcttcataaccggtctgaccgtgcagcacgtcttcatagtagcgctcaatgcccagcttaccgatatcatgcgtcgccgcatagttggccagtttgccgtcattattcaggcgttcgacgtctttatcgttgattttcgacacatagccgatgacgtgggtcaacgctgaaccgtaaggatagtaacgacgtttatagcctttaacttcgacgccaggaaaacggtactggttgacggcaaagcgagctacttgtacttcggtcaggttagttttcaccggaatagaggtgaaacggtgtgaacgtgcgcgctcttttcggaatgcagcaatatcatcatcggtcagatcaaccacgctgcgcaaagcgtccagcgtttgctgcacgttatcgactttctccggcatcatttctatctggtagatagtgcggttgagagccagagggataccgttacggtcgtagataatgccgcggctgggtgcgataggcaccagcttaatgcggttttcattagagcgggtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcacttatcactcacggtgataaggatggttggtggtgatgctccacgcccggtacagactctctgcgaccagcacgcgaaccagcggatggggaagggtaagtgccgacagcgaccagctctgctccgccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtgatcagcaatggacataacatggcggctggacgtacccgtacagatgatcatgcagtcggtgatgctggatttgccctgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccggggctgtcaatggtcgttgcggcttacccgtaaaaaaacagaaaagtcatgcattctcgaccccgatggcacggctattgaggacgcgtagcgtcgcgaatttttggttgatatcaatggcgctccaacacccctggtcaacgcggaaatgccacatagactcggcaggcataccaattaaacgagtaattaacagactcagtacgccctgatggctgacgactaaaatattctgatagtgctgatattcactaagccttgcgataaatcgttccacacgttgcgaaaatgcctgaaatccttcaccgttcgtggggatagcatgctgccagtcattgcaccacgcgctatagttttcggcatcttcttgcatgaggtcacgatgatgtcgcatctcccagtcgccaaaaaacatttcattgagttcagggatgatatgaacggggtgctggcggtcactaagaaccagtcgcgcggtatgctgtgcccgttccagttcactgcataaaaccaggtcaaaggaaacatcatgtagcagcgtatgcagattttgcgcttgctcaataccgcgcgcggtcaggggtgtgggcgcatgaccgctgtacagaccatcgacattcgcttgcgtttcaccatgacgaattaaccacagtcgcatcatgccctccgtaacgacaggtatcagcgatacaagccttgttggttaatgtaagtcagtaccggttccggtaataaatcctcacacgattcaccattttgcaaacgttcgcggatgatggtcgccgagatgttaaaccacggcgtttcagccagataaattttaccggcaggctgaaggtgaagatcttccgggttatgtgtcaaatgatcctccagccattgctgatattgtggttgtgccatttcaagtgggtaacctggacgccgacagacgatcaaatgtgcattgtcgagtatcgtttcgtattcgtaccaggtcggaaaggtcagcaatgaatcctgaccaataataaacgccagcggcacgtccggtccttgctcctgccgccactctttcagtgtttgcgcagtgtaagagggggcattgcgctttagctcgcgttcatcaagagtaaataatggcttgtcggcaatcgccagttcaagcatgtgtttacgctgcatgctgtttgcttccggctggggacgatgcggaggaacattattagggatgattgtgacccgcgtcagaccaatcaaattcgccagcgtttccacgggtttaagatgaccatagtgcaccggatcaaaggtgccgccaaacagagcctgtaaagatttcatatcaaccgtcgataaatacgtccgccaggggtttatggcacaacagaagagataacccttcaagctctgcccacactgactgaccgtaatcttgtttgagggtgagttccgttcgtgtcaggagttgcacggcctgacgtaactgcgactggcttaagcgatttaacgcctcgctcatcatgccccggcggttctgccatacccgatgcttatcaaacaacgcacgcagtggcgtatgggcagactggcgtttcaggttaaccagtaacaacagttcacgttgtaatgtgcgcaacaaaataaccggttcgctgccttccagacgcagttgctgaagaatatgcaacgcgcgcttactttttcccatcaacaaagcatcaacccaatgaaaaggggtgaaatgcgcggcatcattcaccgcctgttcaacgcgcggtaatgtcagtttgccgtccggccagagtagcgataaacgctccagtgcctgggccagcgccagcaggttaccttcataacagtagcagagcacctgatttgcagcgtcatccagttctaagttgagctgttttgcgcgcgcagcaacccagcggggcagctgagcctgctccggtgtctgacaggtcacctgcacgctgcgattcgcaagaacagtaaaccaggcggcattttcttgcgctttgcttaatttattaccgcggacgatcaacagtagatcgtcatgcagaagtccggtgagtgtgagaagttgttcattgatcgccgcattcggtccgttttcgggtaacaacagcaatagcgtttgtcgactggcaaacaggctcatggcctggcataacgaaaaaatcgcattccagtcggtgttgggatcaatggaaaaagtgtggtgttcttcgaacccttgcgccgcagcgacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccggagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatgtcacggccggggatcaacacggtcgcattcaccgtcatgatcatctgatactctgctgtttgaccgttacggaataccgatgcggtatctttcgcgatgctcactttacccaaacgcagggatggaacgtccttacgcgtggtttctttatcaagcaactcgacaccattcagacgtaactggttacgcaccgcacggcttaatggcccgttcggatcgcctgagtccaggatcatgactttcatagtggaaggaacctgcgtggtgtcacgcagatgccagccacacccggcggtgattaacaccgccagagataacaacaatgttgccagatatcgcacgcttcctcccgcgcttagccaacgaccagattgaggagtttacctggtacgtaaatcactttacgtacagtaacgccatcaagatattttgctaccagatgttcctggccagcacgttcgcgaacctgttcttccgttgcgtccaccggaacggtgatttttgcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggactaccgccagcagcgcttcctgcatcagggcgcgatcctgctcgccatcggtcggtgctttcgccagtttgttcatcagctccataatcgccgcaattgcggtgttgaaggtctgacgacggccgatatcatcggttactttagcgatagttttatgcacatcgcgacgcagcgctttctgatcttcagtcagcgcatcgacgttcagtgccgcaacatcaccttttgctgtgtgctcgtacaccagtttccagacacgtttcaggaagcggttagccccttccacgccggactcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcaccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcgataccaccaatgtaaatatccaccggcagccagtagttagccgctttggaatccagcataccttctttgtactccgggcaagtgtagcgcgcatagtaccaggaggactccataaaggtgtcgaaagtgtcggtttcacgcagtgctggcataccgttaacggtagtttttgcccattccggatctgctttaatcgggctggtaatgccgtccatcaccacatcttccggcaggatcaccggcagctggtcgtccggggtcggcattacggtaccgtcttccagcgtcaccatcggaatcggcgcgccccagtaacgctgacgagaaacaccccagtcgcgcaggcggtagttcactttacgctcgccaacgcccatcgcagtcagtttatcggcgatggcgttgaaggccgcttcatggtcaagaccattaaactcgccagagttgaacagcacgcctttttcagtcagggcttgctgagaaagatctggctcagagccgtcagctgccaggataaccggtttgatgttcaggccgtatttagaggcaaactcgtagtcgcgctggtcgtgacccggaaccgccataactgcgcccgtgccgtattccatcaatacgaagtttgctgcccaaacgggaatttcttcgcccgttaatgggtgaaccgctttaaagccagtatcgacgccttttttctccatcgtcgccatttcagcttcggcaactttggtgttacggcattcgtcaataaaggcggccagttcaggattattttccgccgctttctgtgccaacggatgacccgcagccaccgccaggtaggtacaacccataaaggtgtccgggcgggtagtgtaaacggtcagcgtgttgtcatagtcgttaacgttgaaggtgatttccacgccttcggaacgaccgatccagttacgctgcattgttttaacggtgtctggccagtgatccagtttatccagatcgttgagcagctcgtcagcgtaagcagtgattttgataaaccactgcgggatctctttacgctcaactttggtatcgcagcgccagcagcagccgtcgataacttgttcgttcgccagtacggtctggtcgttcgggcaccagttgaccgcagaagtcttcttatataccaggccttttttatacagttcggtgaagaatttctgttcccaacggtagtattccggcgtacaggtcgccagctcgcggctccagtcataaccaaagcccagcattttgagctggtttttcatatacgcgatgttgtcgtacgtccacggtgctggcgcggtgttgtttttcaccgccgcgccttccgcaggcagaccaaatgcgtcccagccgattggctgaagaacgtttttgcccagcatgcgctggtagcgggcgatcacgtcaccgatggtgtagttgcgaacgtggcccatgtgtagtcgaccagaaggatagggaagcatagacaggcagtaatacttctctttgctctcgtcttcggttacttcaaatgtgcgcttctcatcccagtgaagctgtactttggattctatctcttccgggcggtattgctcttgcatggcagccagtggtcctgttttcaatacggctacaaatgtagcgttgatgtggtttttcagatccgcatagcatagcccaaacgcccgcgtcaaaacagcctttcgcgcactcgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggtcgcgtcactgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagagtctgacagcgtctttatgcgggtgattaaagaaagcttgtggcaggagctggcagacatcaccgataaaacgcagcttgaatggcgcgaagttttccaggacctcaatcatcacggggtttatcacagcggagaagtggtagggctgggaaatctggtctgcgagaaatgtcacttccatctcccgatctatacaccggaagtgctgacgctatgcccgaaatgtggtcatgatcagttccagagacgcccgttcgagccgtaatgaaatgagtggcgccggatggcgtgatgtcatccggcgagtgattaagcgtaaaatttcagacgatcagccagtaaatcaacaaagccctgacgatcaacatcgaccattacagtggcattcggtttattgccagtcagataataataatcaacaaccgtcataccttgggtatatttcccttgtgtttccacgccaacccagcgctcaacagtggtaaacaactccggttttaacagccaggcgatggtgcatgggtcatgcagcggtgcgccgacaaagccccatttttcgtctttatgatattcgaggaagaaatccagcagttcggcaacaatggttgaaacagggttgccaatcgcgcggaaacgctcagtgtcttcaacgtggatttgtgctttgtgagtaacatccagaccggccatcaccaccggaattcctgactggaagacaatttctgccgcttccgggtcaacgtaaatattaaattcagccgcaggcgtccagttaccaagccccattgcgccgcccataatcacgatacgggcaattttgctatgcagttccgggtggctattgagcagcaaggcaacgttagtttgcggtccggtagaaacaatggtgacaggttcctcactttcacacagcgttttcgccatcagctccaccgccgtacagttttgcggtgcgaacgtcggttccggtaatgccgggccgtcgagaccgctttcgccgtgcacgttgtccgcaataatcaaattacgcattaacggttttaccgcaccgcttgctaccggaatatcggtgcgattaagcaaggtcagcatacgcagaacattgcgtaaggttttttctggtgtctggtttccggcggaggacgtaattgctttgacatcaagctctggtgaggcgagggcgagaacgattgcgatagcgtcgtcatgacctgggtcgcaatctaacagaattggcagtgccattgttgctccttgttgtgtgtttctttgcgacaagggtaacgccgggatgtaacagatacgagggacgaaacgagaaagcgtgagatggcgcgcaattgagtatgcgcgccagagtgattaatgcaggatttttgcgaggaagtcttttgcgcggtccgatttcggatcatcgaagaaagcgtctttcggcgagtcttcgacaattttaccctcgtccataaagatcacccgattcgccactttacgggcaaagcccatttcgtgggtcaccaccatcatcgtcattccttcgttcgccagttcgaccatcacgtccagcacttcgttgatcatctccggatccagcgccgacgttggttcgtcgaacagcatggcaataggatccatgcacaatgcgcgagcgatcgccacacgctgctgctggccgccggaaagctgcgccggaaacttattggcatgtgcggaaagcccgacgcgctccagcaatttcaatgctttttcacgagccggcgctttattgcgtttaagcactttcacctgcgccagggtcaggttttcgataatcgacagatgggggaacagctcgaaatgctgaaacaccatcccgacgcgggaacgcagtttcgccagatcggttttcttgtcgttaaccacgatgccatcgacggtgatttcaccttgctgcaccggttcgaggccgttgacggttttaatcagcgttgatttgccggaaccagacgggccgcaaaccaccacaacttcgccttttttcacttcggttgagcagtcggtcagcacctgaaagtgaccataccattttgaaacatttttcagggtaatcattatgctgtccttcttttcaagtagctgaccaacaacgatgcgctaaggctaataacgaaataaacaaatccggcaaacaggatcatctcaacctgcgtaccatcgcgctcaccaatggttgaggcggtacggaagaaatcggccagagataacacatacaccagtgaggtatcctgaaacagtacgatgccctgagtgagcaacagcggcaccatcgcgcggaacgcctgcggcagaataatcagtttcatcgactgccagtgagtcattcccaacgccagcgcggcgctcgactgaccacgagaaatactttgaataccagcacggataatctctgaatagtaggccgcttcaaacatcgaaaacgccaccatcgccgaaattaaacggatatcatttttgggtgataatcccagcacgttttgcagaaaacccggtacgatcaggtaaaaccacagcaaaaccataactaaaggaatcgagcggaatacgttaacgtaggctttggcaaaccacgctacgggcgcaaagctggacaagcgcatcaccgccagcatggtgccccacaaaataccaatcaccactgccgtgacggtgattttcagcgtgatcaccagcccgtcgagcagatatggcagggaaggaacaatggaactccagtcaaactcgtacattatttgccccccatgttgccgggcaggcgaactttacgttcaaccagcgtcatcaccagcatgataaaagcgttaatcaatacatacgccagcgtaatggcggtaaacgactcccaggcgtgggccgagtaatcgagcaatttacccgcctgcgccgccatatccaccagaccgatagtcgaggcgatggcggagtttttcaccaggttcatcatctctgaggtcatcggcgggacgataacgcgataagcattaggcagcagtacgtagcggtaggcctgcggtagcgtcagacccatcgccagcgcggcatttttttgcccacgcggcagcgactgaatagctgcgcgtacctgttcgcaaacacgggcggcggtaaacagccccaggcagagcatggatgaaaggaaaaactgaatattgggatccagctctgccttaaaccacatgccgattttctctggcagcagctccgggatcaccaggtaccaggtaaagaattgcacaatcaacggcacgttgcggaacagttcgacatacaacgtacccagaccggagagaaaacggtttggaacggtacgtaaaatgccgaaaaatgaaccgacgaggaaggcgataatccaggcgcagatcgacaaagcgatcgtcacctgaaaaccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttcaggcccgatggggaacgaccaccaggcgtatagtctgtccgtgctacgtaacaatcgagagggctggaatttccgcccctggttcttgtaattagttcagtgccttgtcattcggttctttgaacagtgctttcatttcgtctgacagttcgaaattcatgttcaggtttttcggcggaattgggtttttgaaccatttatcaaaccatttttccgcttcaccggaggtctgcacctgagcgatagtgtcatccatcagctttttgaactgcggatcgtctttacgcaacatgcaaccgtaggcttcctgagactgcggcttgccgacgatttcccagttgtctggtttcttcgctttcgcacgttcaccggccagcagggcatcatccatcataaaggcaacggcacgaccgctttccagggtgcggaaagagtcaccgtgatctttggcgctgatgatgcgcatattcattttttgctcttcattcagtttgttgagcaaaacttcagaggtagtgccggaagtgacgacgacggctttgcctttcaggtcggcaaaatctttgatatcgccgccctttttggtcagcaggcgcgtaccgaccacgaaaatagtgtcagagaaagccgcctgtttttggcgttcggcattgttggtggtagaaccgcattcaaaatcgaaagtgccgttttgcagcagtggaatacggttttgtgaggtgatcggaatcaatttcacctgtaagtctggtttgttgagtttctttttcactgcttcaacaatggcgttggagtaatcctgcgagtagcccaccactttttgctgattgtcgtaataagagaaaggtactgaagattcacggtgaccgacgacaatcacgccgtttttggcgattttgtccagcgtgctgcctgctgccggggcggcgtcatctgcctgtgccagtcctgcggaaagcgccagggccaggattgctgtggcaggtttacgtaattgcatatccaactcctttatcttctgcgttaaaaacgcatggatacccgttgtgagtgtttgtgttgttatcatctgcgactttattgtgcagtgttgtgtttgttaggtaacatttagtttggataaatgtaaagatattgctgttttattgtttatttttgcgaggtgcgccgcaccattccgaagcaaaattcttaaaccgcacctttttggtgctaccgctgatttgtggtggtgcaacccggttgcgttgcggctgatttcattggttacacagtaaataaagcaacttacatgccaaaaaatacttaggggtgaattaattacgattgtaatttcagtttgaaaaagtcatatttcggacagtgttaacttttcggtgtgggacgtttgccgggatgataactacacacgggaaaatgctttttactagtcttttcaaggaagaatcaccttatgtctgcatcttcggttaagccgttaaatgttcaattacccgcaataaccctgatcctttttgcgctctgtgttgggatattttgttacctcgcacaatggatgagttacgaagaagtcgatcaatccgcactcatccatctcggcgctaacgttgcttctctcacgttgtcggatgaatcctggcgcttattgagcagtatttttctgcacagtagtttttcccatttgctgatgaatatgtttgcactcctggcggtggggacagtagcggaacggatactggggaaatggcgactcctgattatctggttattctccggcatctttggtgggctgatcagcgcctgttatgcgctacgcgaaagtgagcagatagtcatcagcgttggggcatccggggcaattatgggaatagcgggcgctgcgatagcaacacagcttgcttcaggtgcgggcatacaccataaaaaccagcggcgagtatttcctctgttgggtatggtggcgctgacactgttgtatggtacccggcaagcaggaatagataacgcttgccacattggcggcctgattgcggggggcgcgttgggttggctgagcgcgcgtttagttgggcaaaaccgattcgttacggaaggcgggattattgttgcggtcactcttcttctgaccggggctatctggcttgtgcagcagcagattgatgaatcagttttacaggtcaggcaaagcctgcgtgaagcgttttatccgcaggagattgaacaagagcgacgacaaaaaaagcagcagttagtggaggagcgcaacgccctcagggaaacattatccgctccggtaagtcgtgagcaggccagtggtgatttactcgctgagattgccgatatccatgatatggcgatcagtcgggatggtaatacgttgtatgccgcaattgaaaacacgaacagcattgttgttttcgacctcggacaaaagaaaatcctgcatacctttacagcgcccatagcgaaagaaaagtcagtcaaacattgtggtggctgtaaagatcagggcgtcagatcgctggcattaagcctggatgaaaagttgatttatgcgacttcatttgaagcgaatgcgttatcggtcattaacgtggcgacgggggagattattcagtcgattaccaccggcgcccatcctgacagccttatcctctcgcgtgatggcacaaaagcctgggtgatgaatcgcaccagcaatagtgtgtcagcgattgatctggtggcttatcagcatgtggcggatatcccgctggagaaatacgacgggacggggatgagcggtaaaccaggcgcctgggttatggcactttccccggatgaaaaaacattactggttccgggagcaggcaggggtaacatcgtgcggatcaataccatcacgcatcagaaagaagactttcccgcaggtgatgcgcgtggtgtcgtttctgcgatgggattccgaccaaaaaatggtgagattatttttgccgatagccaggggatttcacgtataagagctgaggatcaacaagccagcattatgacgcaatggtgtagcaggagcgtttattccgttgagggtattagcccggacggtcagtatttagcgttggtgtcatatggcctgcaaggttatgtcatcctgctcaatattaatgccgggcagattattggcgtttatcccgccagctacgttaataatcttcgtttttcagcggatggtagaaagatatttgttatggcgaagaacaggttaatccaaatggacaggacgcgctcgcttgatccgcaggcaattattcggcatccccaatatggcgatgtggcttgtatccctgaaccgtaagaaaaaagggcatgataatcatgccccagagcgtgttgaaaaagtacgctttatcctacaaaatcgcgaaaattcaacatattgtaaaaatcgcgtaggcctgataagcgtcgcgcatcaggcacattaacgtttgcgagcacgcagactcatcagtacagcggcaaaaccaaacagcgccgtcagcacccacagcggccagttgccggttcgtgcgtacggtgtgagtccggtggttggtgtcacgttagtggtcaacacctcgcgggtgaactgcgggatcatcgcctgaatctcaccctgcgggccaatcaccgccgtaatgccgttgttggtgctgcgcaacagtgggcgcgccagctccagcgcacgcattcgcgccatctggaagtgctgccatggaccaatagacttaccaaaccacgcatcgttggagatagtcagcagatagtcggtatccgggcggaagttatcgcgcacttgctcgccgagaatgatttcgtagcaaatggccgcagtaagttgaatgccattcaacgacagcggtggctgaatatatggtccgcggctgaatgacgacatcggcaaatcaaagaacggtgctaacggacgcagtatcgactccagtgggacaaactcgccaaacggcaccagatggtttttgttatagcgatcggctgattcatagctgtacggtgcgcctttacccagtgtgatgatggtgttgtaggtatcgtagcggttctgtttattgagacgcgcgtcgacaatcccggtgaccagcgagctacctttatcgcgcaactcaccgtccagagctttaaggaacggttgctgattaatttccagatcggttatcgccgactccggccagataatcagcgatgatttgcccatcagcggtgccgttgcgttgtagtaaatcttcagcgtattaagaagctggccttcgtcccatttcagcgattgcggaatatcgccctgaaccatcgaaacctgaatggttttctccggttgcggggtaaaccactggatgtaacgcagcgggaagggaagggcaaacagcacgacggccaccaccagcggacgccagttgcgtttgaccaacgccagtgccagcaagccactaaccatcatcagcaggaagttaatggcttccacgcccattatcggtgccagcccttttaacgggccatcaatctggctatagccgaactgtaaccacgggaagccagtcagcacccaaccgcgcagaaactcggtcacttgccagagagcaggggcggcaatcgccacgcgcagccaggtggttttcggccacagacgcgacagcacgccagcaaacagtccggtatacagcgacaaatacgccgccagcagtaccaccaggaagatgttaaccgggccaggcattccgccaaaggtcgcgatgctgacatagacccagttaataccgctgccaaagaggccaaatccccagcaaaagccaatagcggcagactggagtggacggcggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagcttcggctggggtgagtcatccgggattttgacatgaacctgaataatacgccgactgtcggccatcgccactttgaactggtaaccgtcgatgtcgatggtttcgccacgcgccggaagatgcccaaatgcctgcatcaccagaccaccgatagtgtcaacctcttcatcgctaaagtgggtgccgaacgcttcgttgaagtcttcaatagaagccagtgcgcgcacggtccaggtatggcgactcagctgacggaagtcgatatcatcttcttcgtcatactcgtcttcaatctcaccaacaatcagttccaggatgtcttcaatggtcaccagaccggaaaccccaccgaattcgtcaatgacgatcgccatgtggtaacgctgagagcgaaactctttcagcatccggtctacgcgcttactttcaggaacgacaaccgcctgacgtaacactttgtccatgctgaaggcttcggcatcgctgcgcataaacggcagcaagtctttcgccatcagaatcccttcaatgtgatctttgtcttcgctaatcaccgggaaacgtgagtgggcggactcaatgatgacatcaaggcattcgtccagcgtctggttgcgtttcagggtaatcatctgggagcgggggatcatgatgtcgcgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgatggcttccatttcttctgcttcgtcatcttcgatgtgatcgtaacctaacaaatgcagactgccgtgcaccaccatatgcgcccagtgcgcctccagtggtttgccttgctcctgagcttccttctcaaccacctgacggcagataaccagatcgcccagtagcgacatttccatgccaggcggtacttcaaacgggaaggagagcacgttggtcggcttatccttaccgcgataggtcagattcagactgtggctttcggcggtatcgaccacgcgaatagtcacttccgattcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgctgccagcgccgctttacgtttttgttcggcttcttcccaggcttcataggcgttaacgatacgcgccaccaccgggtgacgaaccacgtcttcgctgtggaagaagttaaagctgatctcttcgacatcagccagtacttcgatggcatgacgcaaaccagacttggtattacgcggcaggtcgatctgtgtgacgtcgccggtgataaccgcttttgagttaaaaccgatacgggtcaggaacatcttcatctgttcgatggtggtgttctggctctcatcaagaatgataaacgcgtcgttcagcgtacgaccacgcatataggccagcggtgcgacttcaataacgttgcgctcaatcagtttctcgactttctcaaagcccagcatttcaaacagcgcgtcgtacagcgggcgcagatacgggtctactttctggcttaaatcgccaggcaggaagcccagtttctcaccggcttctactgccggacgagtcagcagaatacggcgaatttcctgacgctccagggcatcaactgccgcagccactgccaggtaggttttacccgtacccgccgggccaacgccgaaggtaatgtcatggtcgagaatattggcgatgtactgcgcctggtttggcgtgcgcggcttaattacgccgcgtttggttttgatattgaccgctttgccgtactccggcacgctctccgcgctttgctccagtacccgcgcttctttaatcgcaaggtggatctgttccggttcgatatcctgaatctgaccgcgcatcggggcagtatcgacatacaggctacgcagaatgtctgccgcagcggtgacgcaaatcggacggccggtcagtttaaagtggttatcgcggcgattgatttcgatgccgagacggcgttcgagttgtttgatgttgtcatcaaacgggccgcacaggctcaacagacgcgcattgtctgctggctccagggtgatttcgcgagtgtctatgttcaaaccgttcctcttatctgtatgccgccggaagctgaacattcaccggcctataaggaaattattcacgccacaggaaaaaggcgcaagcattgcgataaagatggggataaagagagaaaaaacaaggcccaccggaacggcgggcctgagaattacggctgataataacccacgccaaggtcgttttctttgcgggtacgggcaatcaccgattccggtgtttctgccacgcgcagacccatttcatcttcagttcgcaccactttaccgcgcagagagttcgggtagacgtcggtaatttctacatcgacgaatttaccgatcatatccggcgtgccctcgaagttaaccacgcggttattttcagtgcgaccggaaagctccatgatgctcttacgtgaagtcccttctaccagaatgcgctgggtggtgccgagcatccggcggctccatgccatcgcttgctgattaatgcgctcttgcagaatatacagacgctgcttcttctcttcttccggaacatcatcaaccatatcggcggctggtgtacccggacgtgcagagaagataaagctgtagctcatgtcgaaattgacgtcggcaatcagcttcatcgttttctcgaagtcttcggtggtttcgccagggaagccgacgatgaagtcagagctgatctgaatatccgggcgcgccgcacgcagtttacggatgatcgctttgtactccagcgccgtatgggtacgtcccatcaggttcagaatgcgatcggaaccgctctgtaccggcagatgcaggaagctcaccagctccggcgtgtcgcggtacacttcgatgatatcgtcggtgaattcgatcggatggctggtggtaaagcgaatacgatcgatcccgtcgatcgccgcaaccagacgcagcagatcggcaaacgatccggtggtgccgtcgtagttctcaccgcgccaggcgttcacgttctggccgagcaggttaacttcacgcacgccctgagcagcaagctgggcaatctcaaacagaatatcgtcggacggacggcttacctcttcaccacgggtgtaaggcactacgcagtaggtgcaatatttattgcagccttccatgatggagacaaacgcggtcggcccttcggcgcgcggttccggcagacggtcaaacttctcgatttccgggaagctgatatctacaaccgggctgcggtcgccgcgcacggagttgatcatctccggcagacggtgcagcgtttgcggcccaaaaataatatcgacatagtgggcgcgctggcgaatgtgctcgccttcttgcgatgccacgcagccgccgacgccgataatcaggtctggattcttctcttttaacagtttccagcgacccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttgggggtaaaaatcctgtaaacttaaagcatattgctaacaggatgattgaccatgacaaatcaaccaacggaaattgccattgtcggcggaggaatggtcggcggcgcactggcgctgggactggctcagcacggattttcggtaatggttatcgaacatgcccaacctgcaccgtttgtcgctgacagccagccggacgtgcggatctcggcgattagtgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgttgcttggctacatggtggaaaacactgtcctgcaacaggcgttgtggcaggcgctggaagcgcatccgaaagtaacgttacgtgtgccaacctcgctgattgcactgcatcgccataatgatcttcaggagctggaactgaagggcggtgaaacgatcctcgcgaagctggtgattggtgccgacggcgcaaattcgcaggtgcgacagatggcgggaattggcgttcatgcctggcagtatgcgcagtcgtgtatgttgattagcgtacagtgtgagaacgatcccggcgacagcacctggcagcaatttaccccggacggaccgcgtgcgtttctgccgttgtttgataactgggcatcgctggtgtggtatgactctccggcgcgcattcgccagttgcagaatatgaatatggcgcagctacaggcggaaatcgcgaagcatttcccgtcgcgtctgggttacgtgacaccgcttgccgctggtgcgtttccgctgatacgtcgccatgcgttgcagtatgtgcaaccagggcttgctctggtgggcgatgccgcgcataccatccatccgctggcggggcagggggtgaatcttggttatcgtgatgtcgatgccctgattgacgttctggtgaacgcccgcagctacggcgaagcgtgggccagttatcctgtgctcaagcgttaccagatgcggcgtatggcggataactttatgatgcaaagtggtatggatctgttttatgccggattcagcaataatctgccaccgctgcgttttgtgcgtaatcttggtttgatggcggcggagcgtgctggcgtgttgaaacgtaaggcgctgaaatatgcgttagggttgtagcctcacaacattgctggatgcatgccaaccgtaggtcggataagacgcggcagcgtcgcatccgactttgaaggataagacgagtcaacatcgcattcggcattgaatatacgcagaaaagcaaaaagctcgccgaggcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggtttttgaatttgccgaacatattcgacacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttattcgaagaatatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaagatggtggctacgacgggattcgaacctgtgaccccatcattatgagtgatgtgctctaaccaactgagctacgtagccatctttttttttcgcgataccttatcggcgttgcggggcgcattatgcgtatagagccttgcagcgtcaacctctttttcaaggaaaattgctcgaaagtgactgtttggttaggttgcgaacagcatggcgctatattcgtcaattattgtttactttgtgttttttccccaccctacagccattcttttgtcatacaggatgaaattcggaattcaacaatagtggtgggaaattaatctatgaaatactggcctacagtaatgagttgtcaaacagcgatgtggcaaacccggaacatttccttactgcatatcagaatcaacaagcgccccagtaactgaaattgccccggatttctccggggcaatattacacgtcttatttatatgccgactggtgaacgccaaccgcgcgaccagacggatcgtccattttcttgaacgcttcatcccactcaatcgctttagcggaagaacaagcgacggaaggaccgcccggcacgcactcagcggcgctcggaagcgggaacaattcttcaaagatctcccggtacagatacgcttcttttgaggtcggcgtgttgtacgggaagcggaagcgggcagtttccagctgttgatcagaaacctgctgcgctgccacttctttcagggtgtcgatccaactgtaaccgacgccatcggagaactgctctttttgccgccaggccacgcttgcaggcagatacgcttcaaaacattcacgcaggatgtgtttttccattttgccgttaccgcacattttatcctgtgggttaatgcgcatcgccacatcaaggaattttttgtcgaggaacggaacgcgtgcttccacgccccaggctgacatcgctttgttggcacgcgcgcagtcatacatatgcagggccagcagtttacgcaccgtctcttcatgcaactctttagcgttcggcgctttgtggaagtatagataaccgccaaacacttcgtcagaaccttcaccggacagcaccattttaatgcccatcgccttgatcttacgcgacattaaatacatcggtgttgaagcgcgaatagtggtcacatcataagtttcgatgtggtaaatcacgtcgcggatggcatccagaccttcctgtacagtgaagtgaatttcgtgatgcaccgtgcccagatggtttgccacttcctgggctgctttcagatccggtgagcccggcagacctacagcaaaggagtgcaactgcggccaccaggcttcagagcgttcctgatcttccacgcgacgggcggcgtatttcttggtgatagcggaaataattgaggaatccagaccaccagaaagcagcacaccgtaaggcacatcagacatcagatggcttttaacggaatcttccagtgcctgacgcagctcgtttttgtcggtcacgttatctttcaccgcatcgtagtcgaaccagtcgcgatgataataagaacggatttcgccgtcctgactccacaaatagctccccgccggaaactctttaatcgtgcggcaaactggcacgagggctttcatttctgaggccacatacagctgaccgtgttcgtcatagcccatatacagtgggatgatccccagatggtcgcgaccaatcagatatgcatctttttcgctgtcgtacagggcaaaggcaaacatgccctgcaagtcgtcgagaaattccggccctttttcctgatacagcgcgaggatcacttcacagtcagacccggtctggaactggtaacgatcgccatattcagcgcgcaatgcctggtggttgtagatttcaccgtttactgccagcacatgagttttttgttggttgtagagaggttgcgcccccgcgttaacgtcaacaattgacagacgttcgtgggcgagaatggcgttatcgctggcataaatgccggaccagtccgggccacgatgacgcatcaggcgtgacagctcgagtgctttcttacgcagctcaactgcgtctgttttgatatcgaatatgccaaaaattgaacacataaccttctccgttaacctggtatttgttgcttgttgtgtttgcttgtttaaaaaaatgccgcaaagcagcacggtgcgcaagcgatttggcggtggaaaaataaaaaacgtaatggcgattgctgatttgtgaaaaaggatagggtgtgatggcgtatttattgatggatcgataatttttgacgggttttattgaatagggtgattttaatgatgggtaaaaataagaaaccacgccctgaggcgtggttgctattcagataacgtcgatttcagcgaccgatgggtaaatccaacttgggcggaacggcatactgtcgatatcgtcgagcgacgaaacaccagaaagcaccagaatcgtctccagaccggcctggaagcccgccagaatatcggtacgcaagttatcgccgacaatcaccgtttcttccgaatgcgcctgcattttgtttaatgctgcgcggatgatccacggactcggcttaccaacatagaacggtttacgtccggagattttttcgatccccgcgcatagcgcgccacaggccggataaaaaccgcgcccgtgggtgtccgggttggtggcgataaagcgtgcaccgttagcgacgaaataggctgctttatgcatcatgtcccagttgtaggaacgcgtttcgccaacaatcacaaaatcagggttcacatcggtaatagtgaaaccggctttgtacagttcatgaatcagtgcgccttcgcccaccacatatgctttcttgccttcctggcgacgcaggaaatcggcggttgccatcgcggaggtataaaacacgctgtccggcacatcgacacccgcagtggcaaagcggttcgccagatcttgcccggtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccagctcagaacgtaccaccggcagattagtgcgaaacgccttcagcgcctgggtattaatgcagctttcaatagcagggagcagcactttatcggcttcggtgatttctccggcaataacaattttttgcgggttaaacaggttgatggcaatggcgatggttttgcccagatgacgaccgacatactcaatcacttccgacgccaggctatcgcctttgttcgcagctttgcagatagtttttatggtgcagtcgtccagcggcacgcggctctggtagccctgctttaacagattcaacacccgttgttcaatggcagcgttggcagcgatagtttccaggcagccaaagttgccgcagtggcagcgttcacccagcggttcgacctgaatatggccaatttcaccgacgttaccgttgcggccaataaaaatgcgcccgttagagataatcccggccccggttccgcgatgtacacgcaccagaatggagtcttcgcaatcctgacttgcaccgaagtagtgctccgccagcgccagactacggatatcgtgaccgacgaaacaggtcactttaaaacgttcttccagtgcttctaccagcccccagttttctacctgaatatgcggcatgtaatgaattttgccgctgtccgggtcaacaagccctggcaggatcacggaaatggcgatcagctcgcgcagcttgcgctggtagctatcaataaactgagcaatggcattcagcagggcatgttccagcgtctgctgggtacgttccggcagcgggtaatgttcttctgccagcactttgctactgagatcaaacagagtgatggtggcgtcgtgacgaccaagccgtacgccgattgcgtggaaattgcgggtttcggtgacgatggagatagcgcggcggcccccggtggaggcctgctgatcaacttctttaatcagcccgcgttcgataagctgacgcgtaattttggttacgctggcgggggcaagctggctttgctcggcaatctgaatccgcgagattggcccatactggtcaatcaggcgataaaccgccgcgctgttaagctgttttacgagatcaacattacctatctgagcttgtccgcctggtgtcatactttctcttattgagttacgacctcgttaccgttaacgatggtcctggtgattttaaaatcaggtgtgaatgcagtcaggttggctactttacctgcggcgagtgtaccgagacgtttctcaacgccaatcgcacgcgccggatagagcgtcgccatacgcagcacttcatccagtgcgataccgcaatgttcgaccagattacgcacgccttcaatcatggttaaggatgaaccgcttaacgtaccgttctcatccacacaaagtccattacggtagtatattgttttacccgcaaaaatgaactgttcaatgttggcacctgctggcgcggtggcgtcagtaaccagacacagtttgtcgcctttcagacgtttagcgttgcgaatgttggcgtaatcaacatgcaggccatcagcgataataccgcaataaatgtcagcttcgtcgaggatagcgcccgccaggcccggttcacgaccggtaatatacggcatcgcgttgtacagatgagtggcaaaggtaatccccgcgcggaaaccggcttttgcttctttcaacgtcgcgttggagtgaccggcagaaaccacaatcccggcatttgccagtttgctgatgacttctgcaggaaccatttccggtgccagggtcactttcgtaatcacgtcggcgttctcacacaggaaatcgaccagcgcggcatcaggcttacgcacaaaattcggattatgggtacctttttttaccagattcagccacggaccttccagatgcagacctaacgcctgattcggatgttttgccaggtactcgcgcataacgcgcacgccctgtttcatcagctcgtcgctggtggtgataagcgtcggcaaatagttagtacagcctgatttctcattggctttctgcatgatttccagcgtttctacgctgactgcttcagcagtatcgttaaactgcacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaatattgccctgagcaaggagccagggcagggataataattacagacctttgatattttctgcttctaattcattgaaatatcttaaagtcttaactttcagctccatggtggaaggttcatcgcacaccatgatcgcttttggatgcagttgcagacagctgatggtccacatgtggttcacgcaaccttcaacggcggcctgcagtgccagtgctttctggctacccagcaccagaatcatcacttcttcggcatccagcaatgtaccaacaccgacagtcagggcatattttggcacctgattaacatcgttatcaaagaaacgagagttcgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcattcggcgtcgatatccggggcgttgccgttgagaaggttgatattttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgatgataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggctttaaacgagccaaatagggttctcgtagggggaataagatgaatattttaggttttttccagcgactaggtagggcgttacagctccctatcgcggtgctgccggtggcggcgctgttgctgcgattcggtcagccagatttacttaacgttgcgtttattgcccaggcgggcggtgcgatttttgataacctcgcattaatcttcgccatcggcgtggcatccagctggtcgaaagacagcgcaggtgcggcggcactggcgggtgcggtaggttactttgtgttaaccaaagcgatggtgaccatcaacccagaaattaacatgggtgtactggcgggtatcattaccggtctggtcggtggtgcagcctataaccgttggtccgatattaaactgccggacttcctgagcttcttcggcggcaaacgctttgtgccgattgccaccggcttcttctgcctggtgctggcggccatttttggttacgtctggccgccggtacagcacgctatccatgcaggcggcgagtggatcgtttctgcgggcgcgctgggttccggtatctttggtttcatcaaccgtctgctgatcccaaccggtctgcatcaggtactgaacaccatcgcctggttccagattggtgaattcaccaacgcggcgggtacggttttccacggcgacattaaccgcttctatgccggtgacggcaccgcggggatgttcatgtccggcttcttcccgatcatgatgttcggtctgccgggtgcggcgctggcgatgtactttgcagcaccgaaagagcgtcgtccgatggttggcggtatgctgctttctgttgctgttactgcgttcctgaccggtgtgactgagccgctggaattcctgttcatgttccttgcgccgctgctgtacctcctgcacgcactgctgaccggtatcagcctgtttgtggcaacgctgctgggtatccatgccggcttctctttctctgcgggggctatcgactacgcgttgatgtataacctgccggccgccagccagaacgtctggatgctgctggtgatgggggttgtcttcttcgctatctacttcgtggtgttcagtttggttatccgcatgttcaacctgaaaacgccgggtcgtgaagataaagaagacgagatcgttactgaagaagcgaacagcaataccgaagaaggcttaactcaactggcaaccaactacattgcggcagttggtggtagtgacaatctaaaagcgattgacgcctgtattactcgtctgcgtttgactgtggctgactcagcacgtgtcaacgatgcaatgtgtaaacgtctgggtgcatctggtgtggtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgctcctgtagcaaaaccgcaggctgtaccaaacgcggtatctatcgcggagctggtatcgccgattaccggggatgttgtggcactggatcaggttcctgacgaagcattcgccagcaaagcggtgggtgacggtgtggcggtgaaaccgacagataaaatcgtcgtatcaccagccgcaggaacaatcgtgaaaatcttcaacaccaaccacgcattctgtctggaaaccgaaaaaggcgcggagatcgtcgtccatatgggtatcgacaccgtagcgctggaaggtaaaggctttaaacgtctggtggaagagggcgcgcaggtaagcgcagggcaaccgattctggaaatggatctggattacctgaacgctaacgcccgttcgatgattagcccggtggtttgcagcaatatcgatgatttcagcggccttatcattaaagctcagggccatgttgtggcgggtcaaacaccgctgtatgaaatcaaaaagtaatctgctttatacctgatgcgacacggcagcgtcgcatccaacaataaaaagcggcagggatcttctctgccgctttttttgtctgagattacattgggaagataaaaacagcgcctgcacaaagcgccagaatgcggatgagatacattggtacagagaacacccagaattcgggaagtttgtatttccccattccgaggatcatggctggcattccgtcaataggcatatagccgccattccagccagaaatcaccaccgcaatcgcggcagcggtcgggttaagcccaaggctagtacaggcggcaatggcgatgggggcaaaaatatatactgaccccatattcgaacccgtgaaggtggcgcaggtactggtaagcaaagcaaaggcgacaataaatacaaacggtgagacgccagaaccgagcacacctgcaacggcatcgccaaccatcgccgtaaagccggtgcccgccagtgcatcagctacaccgatcacccccgccatcattaaaatgaccggagcccccatatgatcgcgaacttctttgaagtccagtacatcgatcatcagaacaaacgcacccgcaagacccggaataacgaaggcgatatttcccagaatgttcattagcatcatgccgataacgctgacagcgaatgcggcaatagtgcaatattctttccaggcaggaagggcgttaaacgtttcctcgcgtgccgccagcgcatcctcggaagcatccgcaatgggatgatccggaagaaaacggtaggcaataagactccatgcgaggaaagccgctgacatgatgagattcaccagcgcaaagcgccccatcgaaatctcctgatgaaaccccgcggtttcgagtacggtcgccgtaacgccaaagagaagcgcgagattgataggaagaagcgggtggttggtggcaaatcccaggggcatcattaatttcgatgttggtagctttttactgtacggaatggtggataccagcgacagaattagcacgtaataaccggtcgctccggtgccggcaagactggcacccagcataacaatgactaacaacagcccatagctgcggtaactgcctttattgaccaggcttatcatcgcagatttaacgttgctgataagccgggttttttgtagcgccgccatgaccaccataaaccctgcaatcatcaccacgcttggattgacgaatccggcaaaagcctgttgaacggtcgaaagtcccgatacaaccagcaataaacacgcaagcagtggcggtgcgccaaaaggcattttgtccgacatgatcagcacgatcatcaggaccagtattcctaatgccaggatcatttccattgtcattttttctctccttttaggcttccagcatgtcgcgcggtactttaaagaccgctttgcgtattgaagtagccgtgccaattgcgcacagcgtctggtgaggttcctcaggcataaagacggcgaaatcaccggcgtgtagggtgatggcgacactgttttcaggggatggggcgataaacagatcgggcttacgttcttcatcgttttcgcgagcgatgggccgcgttcccgcattaatgccctcacaaccagtaatcaccacctgtatatcggcccatagatggtgatactccgtatggcggagttcggcgggttgcgtgtctgaagttcccagcgtgcagaaccaccgacatccttcaggttgccagcgaccgtcctctctggtggataacgccgataacgaacactccgggcgcagcagaatatttctcacccaggcaggaagccccgccagcgacaaatggttgagattaccgataatcatgatgcctgccccttaacccactcgggggagatgcgtacgtacttgatggcctgacgccaccaggtgtaagcgatatgtagcgtaccgtccgggctttgtttgatgctggggtaggagaactcacgatttagcttttccagggaattgttggtcatgcagtagccgtcgccttcatcgagattgcgccgccacggccagcttttcccaccatcggcagaaatcgctaccgtcatcggcgcgcgtggggcaccccagaaagcggagcgtccgacggctgtcggttctttgcggctgtcgtcgccatcgtcgatttcgtcataaagcgacgcgcgatgttctactgcgcctgccgcactcatcgcgttgtacaccagcgccagttcgccgctggcaagcgtcgttacctgaatagacgaattgttgttgggcaattcggttgcttgcggcaccgaccaactctcgccgttgtccgcggaatggctgatatagatgttgtctgcccaacggctgcgaaagagagcaaccaacgtaccgttgtgcagcattgtgatattcatatgaacacagccaagactttgcggcacctcgacatcgcgccaggagtgaccaccgtcagcggaaattttcactgcgctgatatcatcattgccgacccatttttcgccgggttgggtacggcaataaaagacgggaagcagccagttaccgttatcaagcaccgtgatcggctggcgaatgaacgtgccgggtttatcgagcagggtggcaatctcgccccaggtttgcccaaggtcgtcagacttacggtagcggacgatggcggtgtcctgattaccggatatttgtgcggtccatagcagccacagcacgttatccggcgcgagaaacagcactgggttttgctctgaacgcgtgtcatcgtgggaaagtttgaccgcatcgctccactgcatcccgccagcgggcaatcgcgatccccagacagaaatatcggcaataccttccagcgttcccgcaaaccagacgcacattaacgcgccatccggcaaaggcagaatattcgccgcgtggttttgtgggcaggacgagggcagcatggcggtaagcacatgcgaatcgttttcggatggacggatgacgccgtcacgaataagggctacagacatagttagactccatcttaaagttggtaatagatttattaatgcgagtgcgattcatgcgtttcgatcaatgtcgaaacttttttatttcttctttcacggataatattgagtgtctcaacacttaatgagaaaaatatcgcgaagtagagatactctttggcaatatgaatgttgagactatcggcaaccagcaatacaccgacaaataataaaaaggttaacgccagtatttttattgacggcgtggcgttaacgaaatcaccaattgttttcgccgcaaacatcatgacgccgacggcaatcattacggcggcaatcatgataaatatatgctgagaaaggccgacggcggtgatcaccgaatccaggctaaacacgatatcgagcagcattatctgtacgatggcaccgcacagcgacagttgccgcgatccgctgccatgttcgtcttcctgcgcgggcgacagctcttcgcgtatctccagtatcgctttataaatcaggaacagcccgcccccgagcagaatcaacgtgcggaacgaaatctccagcgtcagcacggtaaaaagcggctgggtaatatgtgaaagccacgcaatggatatcagcaataatatccgcataatcatcgcgcagcttaaacccagtttacgcgccatattttgttgtgataacggaagttttgccaccaccagtgaaagaaaaataatattatccaccccgagaataatttccagaaaggtgagggtaattaaagtgagccagatatctggctgcataaaccacaaaaacatggggtaatcctttattctctttatctaaactttatagcgggctggataatagagttaatttaattaatgttataatgacgaataatttgttgaatctcgctgatctgttcaggcgtgaaattaaccgcgtagcggctatcaccaacatcatgccccataagctgcaacgctttcttcaccgcagccggggagaatgctactttataaaggtcggtacgcaggcccgttacactctcctgtgcttcataagacccttcaatatcaccggcatggaagcgagaccagatagcattgatttcccgcggtgcgacgttggcgagcccagagatacaggctgaacacccctcgacaaaccctttatggatcagcgaatccgggccgttgagcacattaaagccgtcaatgtcgcgcaccgcatcgagaaaacccttcaggctttcgtcgcttccggcgctgtctttaatcccaatgatattgggatgcgacgccagagcacgcgcggtttctggctggatcgtattgccagtgcgagccgggatgttatagagaaacatcggaatgctcagtgcgtcggcaattgcgctgtaatgcgcaatcaactcttcctgtttcagcggtacgaagtaaggggcaatgaccgacacggcatctacgccaagtttttcaatctgctgacccagacgaatcgtttcgcgcgtagagatctcgccaatgtgtgccacgaccggtgcacgaccagccacttcatccacgcaggtttgcgtaacgctgagcttctcctgttcattcaacacaaaaaactcgccgttggtgccgccgcaaaaaatcgcgttacccgcttccagttgacgattcacctgcacttttaacgccgggatattcagactgccggtcgcggtaaacggggtgacgatagcggttaatacaccttcaatggttttcggcatgatttattccttaaattgatgttgcggaaacagtgtttggtaaatggcctgtacgtcctgtagatcaagctggcacggcacattgttcataaggcgcttcacgttcagtgccgcctcgctaagagaggcaatatcctctggcggtacgccgagatccgcgagattgttgggtagcttgagttgatggactaatgcctgtaaccaggtcaccagggcatgagatttttcttccgtgctcagggcggtttccgcatcgggaatgcaatcccagacccgggcaaatttctcgaccgcccaggggcgaacaaacgccatgcacggcgccagcaagatggcattcgcgacgccatgcggcagatgatatttgccacctaacgggtaggagagcgcatgaacgagatgcgtgcccgcatgggttatcgctacgccgccatagtaagacgcccacagcatttccagttttgcgcgcagatcctgaggatcgttcacggcgggttgaatgtgccggaaaagtttacttaaaccagtcagcgccacgttatcgctgaccggatttgccacggtcgcggtaaaacactccagtaagtggcaaagagcatcaatgcccgtggacgccgcaatatgcgcgggcatgctggtggtcagttccgggaaaagcgccacatagtctggtaacagcacctgggaaataatacccaccttcgtgctttgctcagggattgccagaatcgcattcggcgtggcttctgagccggttccggcggttgtaggaatcaaccatgattgcacccgctgagtcggtttttcacccgcaagcagcgcatccagccccggtgattgtggatggcaaagcaccgatagcagcttcgccacatccaacacgctgccaccgccgatcccgaccaccacatcaaaagaggcatcgccaagggcatccattagctggcgcacatcatgatgcgtgggctctgcgggcacattatcgataacgttaacctgcgggcagtgcttttccagtaaggcgcgaatctgctgcacaccgtcgagctgcgcaatattacggtcagtgaccagcagcatttttctgatgtcgggtaagagcgacgtcagggaagggatagcgcctgcgccgctcagtatcgtgctattgataattaccacaaataacctctcttctggtgattgaattcaatcattcaaaatgccgtagcctacgtaacatggtctaattttataatttattcgagtgattaataacttgagcttgctcacatttaatcaattgtgattgaatataatcattgttatcataaaacaacctggagtgatgatggaaaagggaatcactaagccgagcattctcgtcgttgccgatgatttcacgggagccaacgacgcgggggtaagcctggcgcaggtggggcatacagttgatgtggcctttgaaatgcattatcgcggtgatgccagcgtatgggtgattaacagcgacagccgggcgatggatcctaagctggcggcgatgaaaataacctcgctgatgagtcatctccctctggcgaataatccgccgctcgtgattaaaaagatagattccacgctgcgaggcaatatcggcgcagaaattgaagccctgatgaaggcatgcggtataacgggcgcagtggttgcccccgcatttcctcaggcgggaaggatcacagtggccggtgagtgttgggtaaacggtgtgcggataacggaaaccgagtttgccagcgatccgaaaaccccggtattgagcgcccgaattgcggacatcatccggttgcagacggccattccatgccagcccgttacggtttctcagctcagccatttgtcttatgagcaaccgtggattagcgtgatagatgcgcagacggacagcgacctggatcgcatcgctgccgctgtgatgcaggctaaacaaccgctgctgctggtcggctccgctggtatttgtgatgccgttgcccggcgctccgcgattatgccgccacccaccgtgctggccattattggttcaatgagcgaaatcgctcaacggcagatcgccacacttcattcacacccacgtatcacacagatatacgtcgatgttgaacacattctggcaggcaatgccagtgactatgacgcgcgtattgtgcaggccttgcagaaaggcgaccactgcattgtccacacctgtaacgattctgtagcaaggcatcagatcgacatcctttgccagcgttggcagatgagtcgcgctgcacttggggaaaaaatttgccggtttcttggcgaacttacccggcaagttctgcttcgcacaatgcccgatgcgctttatctctctggtggtgatgtcgcaatggcaacagccagtgcgttaggcgcgaccggatttcgtattacggggaaggtggcgcaatgcgttccatacggtcactttctgggcggtgtctggtcccgttcggtgatgacgaaagccggtgggtttggcgatgagaccacgttgcatcaggttctgaattttatcgaggagaagtgtagtgaataatattattgcggtaacgatgggtgacccggcgggtattggcccggagatcattattaaatccctgagcgaagccgggcttgctggtgccccggtggtggtggtgggctgtgtgcgcacgctgcgacgtattatggcgatgaatatcacgccgcaggcagagttacgcgtcattcaaaaggtgtgcgacgcccattttgctcccggcgtgattaacgtgatggatgagccgctggctaaccccgatgcgctgacacccggagtggtacaggctgcggcaggcgatttagcatatcgctgtatcaaacgtgtaacggctctggccttatcaggcgaggttaaagccatagccactgcgccgctgaataaagaagcgctgcatcttggcgggcataactatccggggcatacggaattgctggcccatcttaccggcagcaaagagtacgcgatggtgctctataccgataagctcaaggttatccatatttcgactcacatctcactgcgtaaattcctggatactttgaatggtgaaagggtcaaaacggttattcgagttgcgaaccacttcctgaaacgtgttggtattgagcgtccgcgtattgccgtggcgggtgtaaatccacatgcaggggaacatggtttattcggcactgaggaaatcgagattatcgcgcctgcgattgaagcaatgcaggccgaagatattgatgttactggcccgtgcccgccagataccgtgtttatgcaatgccatgaagggctattcgatatggtagtggctatgtaccacgatcaggggcatatccctttaaaactgcttggattttatgatggggtgaatatcaccgccgggttgccatttattcgcacttctgccgaccacggcaccgcgtttgatattgcctggacaggaaaagccaagtctgagagcatggcagtttccatccagttagcaatgcagatttcgcgagaataaaatgaagggatataaccggttagagcagatcatggattacctgaaaagccataatctggtcaccgttgatgagctggtggcggtaaccaatgcgtcgccggctacgattcgtcgagacctgataaaactcgatgagcagggtgttatcagccgtacacatggcggtgtgaccctcaaccggtttattcctacccaaccgactacccatgagaaaatgcagcgcagcctggcggaaaaacatgccatcgccagcgcagcggcgtcaatggtcaaagcgggggattccgtcgtccttgatgccggtacgacaatgattgaacttgcgcggcagattacacatttaccgcttcgcgtgatcacaagcgacctgcatatcgcgctttttttggctgaattcaagcaaattgaagtgacgattatcggcggacgtatcgacgactccagccagtcctgcattggcgaacatggtcgtaaattgctgcaaaatacctggccggacgtggcatttttaagctgtaacagctgggatcttgaaaagggtattacagcacccacggaagagaaagccgcactaaaacgcgatcttatcgcgcatgcttcgcgcaaaattctcctggctgacagctcaaaatacggttcatggtcgctgtttaatatcgcgcatcttaatgaactgacagagattattacggatagtcagcttgatgggcagacgcgtagaacgcttgcgtccttgtcgacgcgtttaatcatagccgactaatctatgactctgcggccagctcatccggcaatttaataaatgcgtcaggctggcgacgtttggccttacgtttccagcgcgaggatctgctggcagtagcgcagaaaacgccccaatatcttacgcaaaaccattttttcgctaactaacagttgtcagcctgtcccgcttataagatcatacgccgttatacgttgtttacgctttgaggaatccacgatgagtgaggcagaagcccgcccgactaactttattcgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgtcgattcgatcaaaaacgacgtagagtggttaggtttccactggtctggtaacgtccgttactcctccgattattttgatcagctccacgcctatgcgatcgaactgatcaataaaggcctggcgtacgttgatgaactgacgccggaacagatccgcgaataccgcggcaccttgacgcagccgggtaaaaacagcccgtaccgcgatcgcagcgttgaagagaacctggcgctgttcgagaaaatgcgtaccggcggttttgaagaaggtaaagcctgcctgcgtgcgaagatcgacatggcttcgccgtttatcgtgatgcgcgatccggtgctgtaccgcattaagtttgctgaacaccaccagactggcaacaagtggtgcatctacccgatgtacgatttcacccactgcatcagcgatgcgctggaaggtattacgcactctctgtgtacgcttgagttccaggacaaccgccgtctgtacgactgggtactggacaacatcaccattcctgttcacccgcgccagtacgaattctcgcgcctgaatctggaatacactgtgatgtccaagcgtaagctgaacctgctggtgaccgacaagcacgttgaaggctgggatgacccgcgtatgccgaccatttctggtctgcgtcgtcgtggttacactgcggcttctattcgtgagttctgcaaacgcattggtgtgaccaagcaggacaacaccattgagatggcgtcactggaatcctgcatccgtgaagatctcaacgaaaatgcgccgcgcgcaatggcggttatcgatccggtgaaactggttatcgaaaactaccagggcgaaggcgaaatggttaccatgccgaaccatccgaataaaccggaaatgggcagccgtcaggtgccatttagcggtgagatttggatcgatcgcgccgatttccgcgaagaagctaacaagcagtacaaacgtctggtgctgggtaaagaagtgcgtctgcgtaatgcttacgtcattaaggcagaacgcgtggagaaagatgccgaaggcaatatcaccaccatcttctgtacttatgacgccgacaccttaagcaaagatccggcagatggtcgtaaagtcaaaggtgttattcactgggtgagcgcggcacatgcgctgccggttgaaatccgcctgtacgatcgtctgttcagcgtgccgaaccctggtgctgcggatgatttcctgtcggtgattaacccggagtcgctggtgatcaaacagggctttgctgaaccgtcgctgaaagatgcggttgcgggtaaagcattccagtttgagcgtgaaggttacttctgcctcgacagccgccattctacggcggaaaaaccggtatttaaccgcaccgttgggctgcgtgatacctgggcgaaagtaggcgagtaagtttacgttgtcggatagagcgtttacgccgcatccggcaagaaatatgcaaattatcccaaacgccgcgctctgcggcgttttttctgcttttcttcgcgaattaattccgcttcgcaatttatccataaaataaatttaaaaccacaaaacataattaaataaaatgtaaccgctttcatcttgctggaatttcacgtttttattcttctgcaagcctttcaactgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctatttttttaatttttatttttttcgctgttcacctttggtgcagcaatttatacgtcaaagaggattaacccatgcgtacgtttagtggcaaacgtagtacgctggcgctggctatcgccggtgttacagctatgtcgggctttatggcaattccggaggctcgcgccgaaggattcatcgacgattcaaccttaaccggcggtatctattactggcagcgtgaacgcgaccgtaaagatgttaccgacggcgataaatacaaaaccaacctttctcactccacctggaacgccaacctcgattttcagtctggttatgctgctgatatgttcggccttgatattgccgcgtttacggcgattgaaatggcggaaaacggcgacagctctcacccgaacgaaatcgcgttttcaaaaagtaataaagcctatgacgaagactggtccggcgataaaagcggtataagcctgtataaagcagcagccaaatttaaatacggtccggtttgggcgagggcaggttatattcagccaaccggtcagacgctgttagcgccacactggagctttatgccgggtacttatcagggggcggaggccggggcgaattttgattacggcgatgctggtgcgttgagtttctcctacatgtggaccaacgaatacaaagcgccgtggcatctggaaatggatgagttttatcagaacgataaaaccaccaaagttgattatctacactcccttggggcgaagtacgacttcaaaaataacttcgtactggaagcggcgtttggtcaggccgaagggtatatcgatcaatattttgccaaagccagctacaaatttgatatcgccggtagcccgttaaccaccagctaccagttctatggtacgcgcgataaagttgacgatcgcagcgtcaacgatctttatgacggcaccgcctggctgcaggcgttgacctttggttaccgggcggctgacgtagtggatttgcgcctcgaaggtacctgggttaaggctgacggtcagcagggatacttcctgcaacgtatgactccaacctacgcttcctcgaacggtcgcctggatatctggtgggataaccgttccgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaagaaccggactattgaagagtctgcctacagcctggatgcggtttacaccattcaggacggtcacgccaaaggcacgatgttcaaactgcacttcaccgaatacgacaatcactccgacatcccaagctggggcggtggttacggcaacatcttccaggatgagcgtgacgtgaaatttatgataatcgcaccattcaccatcttctgatgcccgacgcggcaggttttgtgcctgccgcacatttgaggaatttgctatgaaaaaactgattctcattgccatgatggcatcggggctggtagcttgtgcgcaatcaaccgcaccgcaggaagacagtcgtctgaaagaggcttacagcgcctgtatcaacaccgcgcaaggttcgccggaaaaaattgaagcctgccagagcgtgttaaacgtgctgaagaaagagaaacaacatcagcagtttgccgagcaggaaagtgtacgcgtactggattatcagcagtgtctgcacgcaacgcaaaccggtaatgaccaggcggtgaaagccgattgtgataaggtctggcaggaaattcgcagtaataacaaataagtgagagctgtaactctcgcttttcttatttcccttgtataaaaaagccaacctgcaggttggcttttctcgttcaggctggcttatttgccttcgtgtgcgtgctcatcttcgcggcaatcgccttcggcacagtgaccgtaaagatagagactgtggttagtcaggcgaatgccatgttttgcggcgatttcacgctgacgcgcttcgatggaatcatcactaaattcgataaccttaccgcagtcgaggcagatcagatgatcgtggtgatgttgctgtgtcagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggattttcaagcgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcagctcttcagaaatttgtttaacccatttttctacacgttcagcagtcagttccggctgacgatcttcgtcgatagccagaccgacaaagtggtcatcatcagccagaccttttgacgcttcgaagtggtagcccgcggttggccagtgaccaacgatagttgcgccgcgcggttcaatgatgtcgcggatggtgcccaatgcatcgcagaagtattctgcgtaatcctcctggtcgccacaaccaaacagcgcaaccagtttaccattaaaatcaatctcttcgagagtcgggaagaagtcatcccagtcacactgcgcttcgccgtaataccaggttgggatgcccagcagcagaatgtcatatgcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagctcgctacggctcatattgcgcgactccgccagctcgttcagtgcctcgacagcttccgcgttcagcttcagttcgacacgcttaaggccacgtactttgtcgcgttttagttggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcgcctgcccggatggatagcgcgccataatacatcagcgcgatgagtcacgccaacgtccacgcgcggaaagcgacgcgggcgctgggtttttaatcagttgcgttaatcattgagatagcgacggatagcgcgtaatactgcatccggtttttcagcatggacccagtgacccgcgcctgcaatcacatgcgcccgagcctgtggaaattgtgccagtaaatcatcacggtactgctcgctaacatacggagaattgccgccagggataaacagggtaggatgatcccatgccgggattttctcccaacccacaatatgcggatactgatcccacaatactggcacgttaaagcgccactccccgtcaacaaaagatttcaacagaaactgaatcaccccttcttcattaagatgctggcgcattattgccgctgcttgctggcgtgtttgtgcgtctgattcactgactgcgttgatggccgcgaaaatctcatcatgacggcgaacgtgataatcgaccggcgcaatatcaatcgccaccagcttgtcaatgcgatcgggggctagtgcagtaagagccattaccgctttaccacccatggagtgaccgataaatgttgctttgtcgatctgctgtgcatccagggtatcaacaagatcctgcgccatcgccgggtaattcattaccggatctctcggtgaaagaccgtggttacgcatatcaacctggatgatattgtgatcgtttaccagatcgcgagccagtacgccaaggttgtcgaggctgccaaacagaccatggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggacgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgcctggtacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgagcctgcgttcatttccgtactggaagtgctggcagcgaacggcgttgatgtcattgtgcaggaaaacaatggcttcactccgacacctgccatttccaatgccattctggttcacaataaaaaaggtggcccgctggcagacggtatcgtgattacaccgtcccataacccgccggaagatggtggtatcaagtacaatccgccaaatggtggcccggctgataccaacgtcactaaagtggtggaagacagagcaaacgcactgctggctgatggcctgaaaggcgtgaagcgtatctccctcgacgaagcgatggcatccggtcatgtgaaagagcaggatctggtgcagccgtttgtggaagggctggccgatatcgttgatatggcggcgattcagaaagcgggcctgacgctgggcgttgatccgctgggtggttccggtatcgaatactggaagcgcattggcgagtattacaacctcaacctgaccatcgttaacgatcaggtcgatcaaaccttccgctttatgcacctcgataaagacggtgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcgatcaactacctgttccagcatcgtccgcagtggggcaaagatgttgctgtcggtaaaacgctggtttcatctgcgatgatcgaccgtgtggtcaatgatttgggccgtaagctggtagaagtaccggtaggtttcaaatggtttgttgatggtttgttcgatggcagcttcggctttggcggcgaagagagtgcaggcgcttccttcctgcgtttcgacggcacgccgtggtccaccgataaagacggcatcattatgtgtctgctggcggcggaaatcaccgctgtcaccggtaagaacccgcaggaacactataacgaactggcaaaacgctttggtgcgccgagctataaccgtttgcaggcagcagcgacttccgcacaaaaagcggcgttgtctaagctgtctccggaaatggtgagcgccagcaccctggcaggtgacccgatcaccgcgcgtctgacggcggcaccgggtaatggcgcttctatcggcggtctgaaagtgatgactgacaacggctggttcgccgcgcgtccgtcaggcacggaagacgcatataagatctactgcgaaagcttccttggtgaagaacatcgcaagcagattgagaaagaagcggttgagattgttagcgaagttctgaaaaacgcgtaaacatatcaaataagaaaaagggcggtcggaagatcgcccttttttgctttgcttaattaaccgtgtttatttttcagttcaaagcgtggtgagaccagaccatacagtgtccaaccgaggaaggtcacgatggaaccgtatagcatggcttcttccccggatgagtacagcgcataaaagctgtacatcgcgccaacaaaagcaacaaagtttgcaactttcgcttttgaggggggcacattagcgaccttctgaataatgactaatgccgccattgacagaatatacggaatgatattggtcaccacggccaggttaaccagcacgttgaactgactgtttagcgacgggctaatcgtcatcagcgccaacccgctctggataatcacaatggtcaacattccctgcaccggtgcatccactttggttacacgggagaaaattttagggaagtagccttcatcagatgaagatttaaacacctgggcaatggtgaactgccagccaagcagcgaaccgcagcaggacatcaccatcagcgccataatgactttacccacttccggcgtgaacatctgcgcgaaggccagaccaaatggtgccgttgaatttgccagctccatatttggcacaatcccggcaatcacgttggtggagacgatataaatcaccgccgcacctaacgtaccgccgagtaccgcgattggcacattacgttctgggttttccactacatcagtatttgcacacgcagactccagaccaagaaaagcccacagcgtcatagcgatggaagaacctaccgcactgaagaacggtgcatgatgcggattccaggaatcaacgtaaagcgtcgggctaaaccagaaccagccgataatgcacaggcctaccaccggaataatgaccccccacacggtaatgctactgatttgcccggtaatgcgcgcaccaccaaagttagccacggtacaaatccacagcaccccgatggtcgcaagaccaatctgcactggcgacaaactcgcgccgagcagttcggtgccgtaaccaaccgccgaaatagcaatcgcgacgttagcaatcagcagcgagacgccgtaggtatagttcgccataaagttaccggatttaccgaaagcatactccgcataaccgcccataccgcctgatttacggctgaacataccgcattttgcgaatgcccatgccagtgccattgagcctacggctgtcaccagccaggagataattgagattgtcccgacttcggcaagctttgtcggcagcatgatgataccggagcccatcatgttgaccatcgtcagtatggttaactgaacgacacccattttgttcgatttagcctgactcataatttttcccctttcaacagggcgctttgcgcatcacgaggcttgatgacatagcaccaaacttgcttacgaccatcatgttcttcgatatagacaccctgcagctccggtgcaaaacctggcagcaggttgatgccttcttccagagcgctgaagtaacgcagaacagcaccaccccagatttcaccaggaacaacacacagcacacccggaggataaggaagcgcaccttcggcagcgatacggccttctgcatccggcagacgaaccagctccacttcaccgcgtaagtaggcgtagttggcttcttgcggattcatgctgacgcgagggaagtgttccttacggaacatctctttttgcagttgtttcacgttgtgacgggcatacaaatcatgcatttcctggcacaactgacgcagggtataaccggcgtagcgctcttcatgctgtttgtagatggaaggcagtacttccgccagaggcgcatcagcttccagtagtttttcgaagcgtaccagcagggcaacaagttgctgcagtttggccatatcttctgccggagtcagcaggaagaggatggagttaagatcgcatttttccggcactacgccattttcgcgcaggaagttagcaagaatcgttgcaggtacaccgaacgcttcatattcgccgttacgtgcatcaatacctggagttgtcagcaacagtttgcacggatcgacaaagtattggttctctgcgtagccttcaaaagaatgccagtgctcaccgggtacaaatttaaagaagcgcagatcaaccgcaatttgcgctgtttcatacgactgccagggtttaccatccaccagttcaggaacgaacgggcgaatgtgctggcagttatcgaggatcaatttgcgggcattaataccgttaaccacacaatccatccacatattacgaccgctgacaccttcatgcattttggcgttgatatccagtgcggcaaacagcggatagaacgggctggtggaggcgtgcatcataaaggcgttgttcatgcgtttgtgcggtacataacgctgttgccctttgatatggctgtcttttttatgaatttgtgaagtctgagaaaaaccagcctgttgtttatgcacagattgcgtaaccagaatacccggatcgttctcattaagctccagcagcagcggcgaacagtccgccatcatcggaataaactgttcatagccgacccatgctgagtcaaacaggatgtagtcacacagatgaccgattttatccaccacctggcgggcgttataaatagtaccgtcgtaggtgcctaactgaatcacagcgaggcggaacggacgcgcctcttttgcccgttgcggtgcaacttctgtaatcagttcacgcagataactttcttcgaagcagtgcgcatcaatgccaccgataaaaccatacgggttacgtgctgtttccagataaaccggtgttgcaccagcctgtagcaaggccccgtgatggttagacttatggttattgcggtcaaacagcaccagatcacccggtgtcagcagggcgtttaaaaccactttgttggaggaggaggtgccgtttaaaacaaagtacgttttatcggcattaaacactttagccgcatgttgctgtgcaatgcatggcgcaccttcatgaatcagtagatcgcccattgcaacgtcggcattacacaagtcggagcggaagagcatttcgccaaaatattccacgaactgattgcctgccggatggcgacggaaaaactcacctccctgatgacccgggcagtcaaaagcgctattgccctgattgacataatcgaccagtgcgcggaagaagggcgggcgcagttgcgtttcataatggctggcagcggtttctaactgacgtccataaaactctttccgtgattcgcaatgctcgaagacaccagaaatacgtggcagatattctgctggtacacgttcttcattttccgttgcaataaaaacaggaatgccatagccagtagcgtctatttcatcgagttttccacgttcaacatcattgactgataaaataatggcggcaacgtcaatataattacttttgtcaatattcacgcattcacgatgagtggaaaaacaatccgggcaagaacggctaacggcaatttttaattctgacattttgttcatctctttatttcaggtaatagcaggtcctcaatttctcaaaggagaaattgatcacgccggaaaaaagcaaaaccccaccgctgataaataaatcagtagtttgctttttgcagatgcaataacccagaccagcccggtaactggctatactcgtcatacttcaagttgcctatgctgcgactcgaattattaagaggttaaaagggttagcagtatatgagcaccgagggatacaggtattaacctgtaatgcttaaagccagggagacctgtacgctggggtgccctttagtcagaagactagcgggcattaaagaaatgaaagtcaaaactattacgatgggcaaacttcatgatatgggttgtccgccttatatgaggcattaagcggttattattttccatttacctttacctttttctgtgtcagttgaaggtagggttattctatccatgaaatagctataatctgtgaagaagatcaacaaaaaacgatcatatcccaaataataaatcattaatgatgaatagcgccatattagatgctgttttgttgtttaaatgttgcaattttgtgggttgtattttcattaagaaattaaacctgccaaataataattttcggggcaggtttaataataaattaataattatttaagcgtatttattgaataataattcatggcataaaccgatacccaataccggtttcagtaataaaatggcgggggcgggcgggatcttgctccagtttttgtcgcagatgccccatataaatacgcaaatagtggctgtgttcgaccgcgtttggtccccacacctgattgagtaactggcgctgggtgagcacttttccggcgttgttgagcagcacggccagcaggcggaactcaatcggtgtgagatgcacctcttcctcgccgcggtggataacgcgggcggctaaatcgacggtaacatcagaaaatttcaccagcggatcgggcgtggtggtggcggagtggcggcgtaatgcgacgcgcagacgggcctgcaattcgccaatgccaaacggcttactcagataatcatccgctccggcatccagcgcggcgattttatcgctctcttcgctgcgtgcggaaagcacaatcaccggcaccgcgctccactggcgcaggtcgcggataaactcaatcccatcaccgtcgggcaggccgagatcgagaataatcaaatctggcttacgggttgccgcttccagcaagccgcgttgcagtgtttcggcctcaaagacgcgcataccgtcgccctccagcgccgtgcgcagaaagcgacgaatagcctgttcatcttcaacaatcagaacgtttgtcacatatcctcatgaaattcttcaagttcaggggctgtttgctggggaagtgtaacacgaaaacaggcaccaccttccggtcggttgaatgcggtaatggtgccgccgtgtacatccactatcgcccgacaaattgccagcccaagccctacacccggtaccgccgactctttattcccgcgagcaaacttatcaaatatcgtctgctcctggcctggtggaagaccggggccgttatcccagacatccagttgtagattttcgccctcaacgtgggcattgataccaatttcggcctgcgcccccgcatatttcaccgcgttctccagcaggttaatcagcacccgttcaaagagtggcccgtcaacgtggattaaggtcagcggctctggcagagaaagattgatgggcgacgataaacccggttccagcatttgcagcgcgctgccgaccacttcttccagcgttaaccactctttcttcaaattaaagccgccggactgaattcgcgccatatccagtagattattcaccagtcgggtggtgttcagcacatgctgacgaatctcgctggcctggcgggcgtggggcgatccttcgcttgccagatcgagcgttaagatttctgcctgaccgaacagcaccgtaagcggcgtgcgtaaatcatgcgaaagtgccgccagcagggcgttgcggatctgttcacgttcgcttgccatccgcgcctgttcttcgctggcggtcagtgtcagccgctcaagggcattggcgactaacagcgtaaacgtctccagcaggcgctgctgttccgggatcatcaactggcgcagattccccggttccaccaccaccagtccgtaggttttctcgccgctttttagcggcaaaatctggtacggtacaccgggtaacgtgtcggtgcccgcgcccgcaggcaggcctttatcaaaactccactgcgcgatggcatcgtcccacggcgtcattccttgcggatgtgttaaaggctgcaatttaccgttgtcatcaggcagcaacacctggctacgggcatgaaacgtggaggcaataaactgttcgctggtggcggcgatatcctgcgaactacggcccacagccagagctttggacatttcatataagtgccgtgtgcgttgttcgcggtaacgggctacccgcgcctgataacgcacgccagcagtaaggttcccgatcaccagcccgacggttaacatcaccgcgaaggtcagcagatattgcacatcagagacggcgagcgtgccgcgtggggcgataaaaaagagatcgaaactcaccacattaatgacggtggcaaccaccgaaggccagcgtccgtaaaatagtgccaccaccacgacgccaagcagatacagcatcaccaggttggcggcatcaaacgccatcagccactgcatggcaattaaggtgataacggcgcataacgcggcggcaaccacgcatccctgaatctgtacccgccacttgtctttaaaagagcggctatccggcgcgttgttaatcgtgcgggcgggtggttcatcaagcgcaaccagcacctgatcgagatcgggggcgatgcgtgccagccggtcagcaaatgtttcccgacgccaccagcggcgcgaagccgggcgaccgagaataatcttgccgagattatgttcacgggcataacgcactaccgctttttcttccgctggatcagaaagtgttgccgtctccgcgcccagctcctgcgccagacgtaaggcgctgagaattgcccgacgttttttctccggtaagcgatgcagggcaggggtttcaacatacaccgcgtgccagacactgcccaggcgcgaggccaaccgcgccgccgcgcggaccagtttctcactgccggtgttatgcccgatgcataataggatcgcgtcgcgtgtgtgccagactttctcttcgccaggatgcccccgccaggcgcgcatttgctcatctacgcgatcggcagtacggcgcagtgccagttcgcgcagggcgatcagattacctttgcggaaaaaatgttcaatggcgcgctccgcctgcccggcaatatagactttgccttctttcagtcgctggcgcagatcgtccgggggcaagtccaccagcaccacgtcgtcggcggcatcaaaaaaaggatcgggcacggtctcccgtacctgaattccggtgacgccgctgaccacatcattcagactttccagatgctgaacgttgacggtagtgaaaacatcaatgccagcttccagcagctcctcaatgtcctgccagcgtttaggatgacgtgaacctggcgcattactgtgcgccagttcgtccattaagatcagtgccggacggcgggcgagggcggcatcgagatcaaactcgctgatgtgccgcccacggtacgcctggcgttttaacggcagaacagccagacctttcagcattgcggcggtatctttccgaccgtgggtttctaccacgccaaccacaatatccagcccttgcgcccgcagtcgctgggcttccgccagcatcgcccaggtcttcccgacgcctgcgcaggcaccgaagaaaactttcagcttcccccgatgcggcgcggcagcttgttccagcagacgatcggggtcgggacgtaagggttcgttattcatcaagcttatccagtgccagattgagttcgacaatgttgacgaccggctggccgatatatttcaccagcggttgttggctgtattttgcgatcagttgcgtgagctgttcaacgctgagattacgcgctttcgccacgcgtgggatctgccaggccgccgcttgcggggtgatgttattgtccagcccgcttgctgacgccgtcaccagttcaaccggaacgttcgtgctggcatccgggttagcagcccgtaatgcagcaacgcgtgcggctatctgtttatccagctccgggttactgaccgccaggttgctcccgccagaagcctgtggattatagggcatttctgctgttgccgacgggcgaccatgaaaatagccgttgccggtaaaattttgcccgattaatgccgaaccgcgcaccgtatcaccttcacgaatcaatgaaccgttggcctgccagggaaaccaccattgccccagtgcggtggtcagcagcgggtaaacgccgccagtaatcaataacagaaagagaaatgtcgataatgccggacgtaatccacgcatggtaaacctcacaccagaccgcaaacggttagcagtaaatcaatgactttgataccaataaacggcaccagcagcccacccagaccgtaaatccataagttacggcgcaacatggcagaagcggtaagcggtttataactcacgccttttaacgccaggggaatcaaaaagacgataatcaaggcgttgaaaatgaccgcactgagaatggcggagtcgggcgaatgcaggcgcatgatgttcagcgcatttaactgcggatacgttgccgcgaacgccgctggaataatggcgaagtatttcgccacatcgttggcaatgctgaaggtggtcaacgagccacgggtcatcagcatctgtttgccaatgtgcactacctcgatcaacttggtcgggttggagtcgagatccaccatattgcccgcttctttcgccgcctgggtgccggagttcatcgccaccgcaacatcggcctgtgccagcgccggagcatcgttggtgccatcgccggtcatcgccactaaacggccttccgcctgatactgacgaatcagtgccagcttggcctccggtgttgcttcggcgagaaaatcatcgacacccgcttccgcagctatcgcggcggcagtcaggcggttatcgccggtaatcatcaccgttttaatgcccattttacgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggcagggaagtgaccgccgttagcctcaacatggcggcgaatggcatcgacagaacctttacggatcatgcggttgtcgatgttgatcccgctcatccggctttgtgcagtaaacggtacaaaggtggcatggagcgactgcacatcgcgctcgcgcaggttaaaacgctgcttggcgaggatcacaatactgcggccttccggcgtttcatcagccagcgaagccagttgtgcggcgtcggccagcgctttttcctccacgccttgtgcggggataaactctgacgcctgacggttaccgagggtgatggtgccggttttatccagcagcagaacgtcaacatcacccgctgcttcaactgctcgcccgctggtggcaataacattcgcgcccagcatccgactcatcccggcgacgccaatcgctgacaacaggccgccaatagtggttgggatcagacagaccagcagtgccaccagtaccgttacgctgactgcattaccgccccacgcggaaaacggccacagcgtggcggttgccagtaaaaagacgatagtcagggcaatcaggagaatggtcagggcaatctcgttcggcgttttacgtcgctgcgcaccttccaccatcgcgatcatccgatccagaaatgtctcgccggggttaacgctgcactcaatcaccagccagtcagaaagaatacgcgtgccgccagtgacggaggcaaaatcaccgccggattcacggatcaccggagccgattccccggtgatggcgctttcatcgaccgatgcgccgccttcaatgacttcaccatcgcaggggataatatcgccagcttctaccagcacgatgtcacctttacgcagttgatcagcaggaactttgtccgccgcagcgccatatttcggttcgcgcagtttgcgagcaaaagcggtttttttcacccctttcagactgttggcctgcgctttactgcggccttctgccaacgcctcggcgaaattagcgaacagtacggtgacccacagccagccgctaattgccgcgctaaacagcgcattgccaggcatcacaccgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcaatgtgccggagctggcgggttggctctttttactcaccagcgaaccggcaattgccatcaccgggataatcaccccgaagcgcccgacaaacatgcacaacgccagtaaacagttccagaatggagagttggcgcttaatccggcaaaggcgctgccgttgttgttagcggcggatgacacggcgtacagcacttcgctaaaaccatgcgggccagggttgagcatggcgctacgtccggcgtcggtcatcattgccagcgccgcgcccatcagcaccagcgtcggggtgaccagaatcgccagtgcagtcagtttcatctcgcgtacgtcgatttttttacccagatattccggtgtacgaccaatcatcagcccggcaataaacaccgccagcaggacaaacagcatcatgccgtaaaggcctgaaccgacgccgccgaataccacttcaccaatttgcatcaaccacatcggcaccatgccaccaagagcggtaaacgaatcatgcatcgcaatcaccgcgccgcaggaagccgccgtagtcacgaccgcaaacaggctactgaccagcacgccgaaacggctctctttaccttccatattgatgctgctgtccgcgccgagcgccagcagatgcggattaccctgaacttctgcccacatcactacgcctacgcagatgacaaaaatcaccgacatcgcccacagcaacatgcgcccctggcgacgatcgcccgccacttcaccaaaggcaaagcacagcgctgttgggatcaagaaaatcgccagcatttgcacgaagttggtcagtgcggttgggttttcaaacggatgcgacgagttggcattaaaaaagccaccgccgttagttccgagcattttgatcgcttcctgagaagctactggccccattggtaacagctgttgcgctccttcaatggtcgtcacagcctgataaggcaaaaagttttgcagcgcaccttgttgaataaaaaacagtgcgatcagcaatgctacgggggttaacacccataacgtaatccgcaacaggtctacccacgcattacccagcgtgttcatgctctggcgggtaaacgcgcgaataagcgcaaaaatcaccgcaatcccgctggcggcagaaagaaagttttgcaccgttaagcccgccatctggctgaaatagctcaacgtggtttcaccgctataagattgccagttggtgttagtgacaaagctgacggcggtattgagcgccagatcccacgacagccccggcaactgctgtggattaagcggcagatagtgctggccgagcaacataaaaaacagcaccgccagccccagtatattcaggccaagaatggctgagagatactgcttccagttcatctcgcggtcagagacgccaagcgcgctaaagagtacgcgttcaacgcccgtcgtaccaggaagaggtatatcattaatcagccgcgccagcccgctacctaagggacgcgccagcaccattaataccagtaaaaacgtggcaatcagtaagaacccttgcgcagccatcagaacgcctccgcattgatcagggcataaaccagataacccagtaataaaaacaccagcaacacgccggctatcacgcctgcactcacagtgcacctccagtggcctaaaagtgataccggaagggtagagttctggctgcaaagatttcgcaaaaatctgcgggcggggtgtaaaaaaagtataaaaatggcaaaagccatggtttaactaatgtttagtattaatttaacttttatgtaacttaattacacggtgaatgtaaataaaccatcaataagcaaaaataagtggtcggatgagtagtaaaattacacaaacagcggtactattttcatcagataaacgaattcatttttccggtgctattcaccgggtagatacaaaagggggagaaaagtatggaactctacaaagaatatcctgcatggcttatctttttacgccgtacttgtgcggttgcagcgggcgttctggcgctgcctttcatgcttttctggaaagaccgcgcccgcttttatagctacctgcaccgcgtctggtcgaaaaccagcgataaaccggtgtggatggatcaggccgaaaaggcaaccagtgatttttactgattgccaaacatgacgtttaaagaaaaccgccggtggaaacgctggcggttttcttttttcggcgtctacacttactcctgtaaaccgttcaggagcagtaatgaatcaacaactttttgatgacagcacccttatccgcatttttgctttgcatgagttacacaatctcaaagatcgaggactaacgcgcggggcgcttctcgattatcacagccgctataaactcgtctttctggcgcattctcagccggagtaccgcaaacttggcccgtttgtggctgatattcaccggtggcaaagtctggatgactattacaaccagtaccgccaacgcgtgattgttttgctttctcaccctgccaaccggcgtgatcatactaacgttttgatgcacgttcagggatattttcgcccacatattgattccacagaacgccagcagctggcggcgcttatcgacagttatcgccgtggcgagcaaccgcttcttgcgccgctgatgcgtatcaaacactatatggcgctttatcctgacgcctggctttcagggcagcgttatttcgaactttggccgcgtgtgattaacttgcgccatgcaggagttttatgactacccatctggtctggtttcgccaggatttacgtctgcacgataatctcgcgctggctgccgcctgccgcaattcgtctgcgcgcgtgctggcgttgtatatcgctacaccacgccagtgggcggcgcataatgtgtcgccgcgtcaggctgaacttatcaatacacaacttaatgcgctacaaatcgcgctggcggaaaaaggcattcctttattgttccgtgaagtggatgactttgccgccagcgtcgaaatagttaaacaggtgtgcgcggaataccgcgttactcatcttttttataactatcagtatgaggtgaatgagcgggcgcgggatgtgcaggctgagaggacgctgcgtaacgtggtgtgtgaaggatttgatgatagcgtgatcctgccgccgggggcggtgatgactggcaatcatgagatgtacaaagtctttacgccttttaaaaacgcatggttgaaacggctgcgggaagggatgccggagtgcgtcgctgcaccaaaagttcgtagtagcggatcgatagagcccgcgccatccattacgctgaattatcctcgtcagtctttcgatactgcgcatttcccggtggaagaaaaagcggcgattgcgcaattacgccagttttgcctgaacggtgccggagagtatgagcaacaacgagattttccggcagtggaaggcaccagtcgtttgtccgccagcctggcaacgggcgggttatcgcctcgccagtgtttacatcgcctgttggcggaacaaccgcaggtgctggaaggcggaccggggagcgtctggcttaatgagctgatatggcgcgagttctaccgccatttgatgacgtattatccttcgctgtgtaaacatcgtccgtttattgcctggacggatcgtgtacagtggcaaagtaatcccgcccatttaaaggcctggcaggaaggcaaaacgggatacccgattgtcgatgctgccatgcgtcagcttaacagcactggctggatgcataaccggctacggatgattacagccagttttctggtgaaagatttgttgatcgactggcgcgaaggcgagcgatatttcatgtcgcagctgattgatggtgatttggcagctaataacggtggctggcagtgggccgcttctacgggtactgatgcagcgccgtattttcgtattttcaacccgacaactcagggcgagaaatttgaccgcgaaggcgaatttatccgccagtggctaccggagctgcgcgatgtaccggggaaagcggtgcatgagccgtggaagtgggcagagaaaacaggtgtgacgttggattatccgcaaccgatagtcgatcacaaagaggcaaggctgcgaacgctggcagcgtacgaagaagcgaggaaaggagcctgataaaacgcagcgagcgttttatcaggcatggtgctggcttattaagactccagcgccagcgcgcggtttctgaacttaagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcaatcgcgccggaaagcagcatataaatgccggttaatacgccggtcacgccggggatttcaatgcgcgtaatctgcgacatagcaaccggatcgataaacagttccgcaaagcccatcaccgccaggcctaacaccatcagtggcagagaagagtgaccatacattgcggaccagcgggcgcttaaggtcagaatgcagaatccggcgctcatcaggccaaggccaagagcaaattttccccagatgcgcacggtacgattacctgcgacgctttctttaaccacccacgccaagaacacaccgcacagcataactgcgaaggcattaatcgactggaacatagcagtcggaacggtataaccaaacatatcgcggttaacgaagcggtcgatataaaggctaatcgagctacccccctgttgtgcgaatgcccagaacaacatgctgaagaaggtgagggtaacaatcagccccagctccttacgctgtttttggttttctgctttgcgataaatttttgccagaaccccaaggccaatgatcgtcgcgacaatcaaggcgtataccgaccactctttccagaacaacacggtaatcagcgcaggcgttgccaccagcagaaccagtagccatccccagttgggcaggagaaagtttgtcgcacgcagtacctttttgttaacgccgcgggtatgtgtgaaatgacgattgccacataagaaaatgaccagacccgcgatcatacccaccgccgccaggccaaagcccatcgcccaactgtactcttcctgggcgaaaccacaggcgataggtgcgataatagaccccacgttacccgccgcatacatcagcgagaaaccgccatcacgacgtggatcggttggctcatacagctcaccgagcaggcaactgacgttggatttaaacagaccatagccgcagacgataatcgccagtgacagatagaggaatgacggatggatctcactggcacccagcaccacatgaccgatcgccatcaacaacgcccccagcatcaccgccatgcgattgccgagaactttatccgccaaaaagccaccgaggattggcgtgacatataccagcgaacagtaggcgctaaataactcgtaggcgtgattatcgctatattttagttgattggtgagatagaggatcagcagggcacgcatgccgtaaaagctaaaatattcccagatttgcagcgcaacgacatagtaaatagcgagcggttgtgatgcgtgtttattcataataattccacaattgactgcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgtttcttaatatgtcaaaagattggctatcgacgaacaggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcactgccagccaggctttgctcgatgaggcagtgcgtctgggcgcggatgcggtcattgtgcatcatggctacttctggaaaggcgaatctccggtcattcgcggaatgaagcgtaaccgtttaaaaacgttgctggcgaatgatatcaacctgtatggctggcatctgcccctggacgcgcatccggagctgggtaataacgcacaactggcggcgttactggggatcacggtcatgggcgaaattgagccgttggtgccgtggggcgaactgaccatgcctgtgccgggactagaactggcctcctggattgaagcgcgtctgggacgtaagccgttatggtgtggcgataccgggcctgaggtggttcagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcgggtcaccatgccactgaacgcggtggtattcgcgcattgagcgagtggctgaatgaaaataccaatcttgatgtgacctttattgatattcctaatcctgcataacgaataatcagagggatcgaaagtgcaacgagcgcgttgttatctgataggtgaaacggcggtagtgctggaactggaaccgccggtgacgctggctagccagaaacggatctggcgactggcacagcgtctggtgaatatgccgaatgtggttgaagccattcctggcatgaacaatatcacagtgattttgcgtaatcctgagtcgctggcgctggatgccatagagcgtttgcaacgctggtgggaggagagtgaggcgctggagccggagtctcgctttattgaaattccggtggtttacggtggcgcagccggaccggatttggcggtggtcgcggcgcattgtggattgagcgaaaaacaggttgttgaattgcactcctccgtggaatacgtggtctggtttttaggttttcaaccgggcttcccgtatctcgggagtttgccggaacaactacacacgccacggcgcgctgaaccgcgcttgcacgttccagcaggttctgtcgggatcggcgggccgcagaccggtgtttatccgctggcaacgccgggtggctggcagttggttggtcatacctcactcagcctgtttgatccggagcgtgacgaacccatcttattacgtccgggagacagcgtgcgctttgtaccccagaaggagggagtatgctgaagattattcgtgcgggcatgtacaccaccgtgcaggatggcggccgtcacggctttcgtcagtctggtatcagccactgtggcgcactggatatgcctgcgctgcgcattgctaacctgctggtgggtaatgacgccaacgcccccgcgctggagatcacgctcggtcagttaacggttgagttcgaaactgatgggtggtttgccctgacgggtgccggttgcgaagcgcggctggatgataacgccgtctggaccggctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccaggtgtggtgcaggtgccgcataacgggcagcccattgtgttgatgaacgatgcgcaaaccaccggtggttacccgcgtattgcctgtatcattgaggctgatatgtaccatctggcgcaaattccgctcggtcagccgattcattttgtccagtgttcactggaagaggcactgaaagcacggcaagatcaacaacgttatttcgaacaattagcgtggcggctgcacaatgaaaattgacctgaacgccgatctgggcgaaggctgcgccagcgacgcagaactattaacgctggtttcctctgccaatattgcctgtggatttcatgcaggcgatgcgcaaaccatgcaggcttgcgtgcgtgaagcaataaaaaatggtgtcgcgattggcgctcacccgagttttcccgacagggaaaattttggtcgcagcgccatgcagctgccgccagaaaccgttttcgcccagacgctgtatcaaattggcgcgcaggcagcgattacccgtgcgcaaggcggcgtaatgtgtcatgtcaaaccgcacggcatgttatacaaccaggcggcgaaagaggcacaactggcagacgccatcgccagagcggtatacgcttgcgatccggcattgattctcgtcgggctggcaggaagcgagctgattcgtgcaggcgaacgatatggcctggtaacgcgcgaggaagtgtttgccgatcgcggttatcaggcagacggttcgctggtgccgcgaagccagccaggcgcgttgattgaaaacgaagaacaggcgctggcgcaaacgttggagatggtgcaatacggcagagtcaaaagtatcaccggcgaatgggcaatggtcacggcgcaaacggtctgcctacatggcgatggcgagcacgcactggcgttcgcccgccgattacgagctacatttgctgaaaaggggattgttgtcgcagcataaccccgcttaataaagaatgaaaaaaggatatcaccatgcctgaaggcccggagatccgccgtgcagcggataacctggaggcggcgatcaaaggcaaaccactaactgatgtctggtttgccttcccgcagttaaaatcttatcaatcacgacttatcggtcaacacgttacccatgtggaaacgcgtggtaaggcgttgttaactcatttttccaacgacttaacgctctacagccataatcagctttacggcgtctggcgcgtggttgataccggcgaagagccgcagaccacgcgagtattgcgggtaaaactgcaaacggctgacaaaaccattctgctttatagcgcctcggatattgagatgttgactccggaacaactgaccacgcatccgtttttacaacgcgttggtcccgatgtgctggatccgaatctgacgccggaggtggtaaaggaacgattattgtcgccgcgctttcgtaaccgccagtttgctggattactgctcgatcaggcgtttctggcaggacttggcaattatttgcgggtggagatcctctggcaggttgggttgaccggaaatcataaagcgaaagatctcaatgcggcgcaactggatgcactcgcacacgcgttactggatattccgcgactttcttacgctacgcgggggcaggtggatgaaaacaaatatcatggggcgctgtttcgctttaaggtttttcatcgtgatggcgaaccgtgcgaacgctgtggcggcatcattgagaaaaccacgctgtcatcgcgcccgttttactggtgccctggctgccagcactaggccgaacgcttcggcgcataggttgaaataaaccgtgcgatggcaggccccgtcagcaaaatactgaacaggcgcagggtttgcatcgccatgatgagcgccatatcggcattgctccctgcggcgatgaccgccacggtatcaagcccgccggggctggtggcgaggtaggcggtcataaaatcaatatgcataaaccgggtcagcccccacgccatacccgcacaaatagccagcagagcaaaaatcgacagcaggatttgcggtagcgggcgcaatgcccgcagtaatatttgtttatcgaaaccaagaccaatccgccagccaattgccatatatgccatcgccagcagccattccgggagttcaatcgtgatgagctgacctgactggagcactgcgcccgccagcatcgggatgagcatcgtgccggaaggaagacgtagcaagcatcccgccgtaccggcaacgaccgcgagcaaaatcgtaagcaggagattaatgctcactggcgggaaccagacgatctgctggttaaccgcttcagcgttatcgcccagcatcatgcgggtgaccagaacagcggcccccgcgacgaacagcactcgcagatattgcataaacgccaccaggcgaatatctgcgccgtaatcttgcgccatagcgaccattgccgccgcgccgccaggagaagaaccccaggcaccggtatttccaggcagtgagctatagcgcaccaataaccaacccacgatggcgctggaaagcagcgtcaccagtaaaatcgcaagcacgatcggccagttgacggccagcgtggtgagaatcgaaccagtgaggttttgtgcaatcatgcagccaagaatggcttgggcagcgagaaaagcggagcggggaagttgcagagtgactccgcgcatactgaagatgatccccgcgatcatcgggccaagcaggagtgccgccgggagatgtaaagcgaggaagccaatagaaaggagaagtgacagaacacataacattccccactgcaatacaggcattcttcgcttcctcattattttatctttggtgtatcgatacagcataaagaaagctgggtctggaaaaaataacggtaatcaaggaaaaggggaaaatcagcaataatctgaatacgttgccctttccggctgaaaagggcgtcgtgttaaatcagttatagttaatcttaaaaagtaccactgtatcgaagggacccgccgcgatgggagtgccaggtgtggacgataattcagccgtataggttttttcgtagatcagcatatcactggtgaaatcggcgtattaagcatatttattgaatgtataaggcgaggcgttttcatccagtatacgtagcttcagaccattaccaatcaacaatgctttatcttcttcaaccaacgttttttcggtataaaacgaggagctgaccttaaatccgtcggtacactggtcattttgcgattttgttgtcttgatactgaatgttttcgacattgtgtggcggcgaatatccagtaagttaaatttacccaaatcaatcaccagtgtttccggtgaaatattttttcaccattattaatgggtatttgcatctggtttaatttttacaattttttatgttcagccatataaaaagaacccgctctattaaaggcgggtccggaaagtgaacggcttagcaatcaaccattaacgcttgatatcgcttttaaagtcgcgtttttcatatcctgtatacagctgacgcggacgggcaatcttcataccgtcactgtgcatttcgctccagtgggcgatccagccaaccgtacgtgccatagcgaagatcacggtgaacatagaagacggaatacccatcgctttcaggatgataccagagtagaaatcgacgttcgggtacagttttttctcgataaagtacgggtcgttcagcgcgatgttttccagctccatagccacttccagcaggtcatctttggtacccagctctttcagaacttcatggcaggtttcacgcattacggtggcgcgcgggtcgtaatttttgtacacgcggtgaccgaagcccatcaggcggaaagaatcatttttgtctttcgcacgacgaacaaattccggaatgtgtttaacggagctgatttcttccagcattttcagcgccgcttcgttagcaccaccgtgcgcaggtccccacagtgaagcaatacctgcagcgatacaggcaaacgggttcgcacccgaagagccagcggtacgcacggtggaggtggaggcgttctgttcatggtcagcgtgcaggatcagaatacggtccatagcacgttccagaatcggattaacttcatacggttcgcacggcgtggagaacatcatattcaggaagttaccggcgtaggagagatcgttgcgcgggtaaacaaatggctgaccaatggaatacttgtaacacatcgcggccatggtcggcatttttgacagcaggcggaacgcggcaatttcacgatgacgaggattgttaacatccagcgagtcgtgatagaacgctgccagcgcgccggtaataccacacatgactgccattggatgcgagtcgcgacggaaagcatggaacagacgggtaatctgctcgtggatcatggtatgacgggtcaccgtagttttaaattcgtcatactgttcctgagtcggtttttcaccattcagcaggatgtaacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtgtccccgttgagggtgagttttgcttttgtatcagccatttaaggtctccttagcgccttattgcgtaagactgccggaacttaaatttgccttcgcacatcaacctggctttacccgtttgttatttggctcgccgctctgtgaaagaggggaaaacctgggtacagagctctgggcgcttgcaggtaaaggatctattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgcttttcctggtaatgtttgtaacaactttgttgaatgattgtcaaattagatgattaaaaattaaataaatgttgttatcgtgacgcagatcactgttcgggataaaacccgacaaactatatgtaggttaattgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctcctggtaacagaaagttaacctctgtgcccgtagtccccagggaataataagaacagcatgtgggcgttattcatgataagaaatttgaaaaaacaaagacctgttaatctggacctacagaccatccggttccccgtcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcatatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgtgctaccgctatcgtcctgacgctctacatcatttatatggtcggttttttcgctaccagtggcgagctgacatatgaagtctggattggtttcttcgcctctgcgttcaccaaagtgttcaccctgctggcgctgttttctatcttgatccatgcctggatcggcatgtggcaggtgttgaccgactacgttaaaccgctggccttgcgcctgatgctgcaactggtgattgtcgttgcactggtggtttacgtgatttatggattcgttgtggtgtggggtgtgtgatgaaattgccagtcagagaatttgatgcagttgtgattggtgctggcggcgcaggtatgcgcgcggcgctgcaaatttcccagagtggccagacctgtgcgctgctctctaaagtcttcccgacccgttcccataccgtttctgcgcaaggtggtattaccgttgcgctgggtaatacccatgaagataactgggaatggcatatgtacgacaccgtaaaagggtcggactatatcggtgaccaggacgcgattgaatatatgtgtaaaaccgggccggaagcgattctggaactggaacatatgggcctgccgttctcgcgtcttgatgatggtcgtatctatcaacgtccgtttggcggtcagtcgaaaaacttcggcggcgagcaggcggcacgtactgcggcggctgccgaccgtaccggtcacgcactgttgcacaccctttatcagcagaacctgaaaaaccacaccaccattttctccgagtggtatgcgttggatctggtgaaaaaccaggatggcgcagtggtcggttgtaccgcactgtgcatcgaaactggtgaagtggtttactttaaagctcgcgcgacagtgctggcgactggcggggcagggcgtatttatcagtccaccaccaacgcccacattaacactggcgacggtgtcggcatggctatccgtgcaggcgtaccggtacaggatatggaaatgtggcagttccacccgaccggtattgccggtgcgggcgtactggtcaccgaaggttgccgtggtgaaggcggttatctgctgaacaaacatggcgaacgctttatggagcgttatgcgccgaacgccaaagacctggcgggccgtgacgtggtggcgcgttccatcatgatcgaaatccgtgaaggccgcggctgtgatggtccgtgggggccacacgcaaaactgaaacttgaccatctggggaaagaagttctcgaatcccgtctgccgggtattctggaactctcccgcaccttcgctcacgttgatccggtgaaagagccgattccggtaattccaacctgtcactacatgatgggcggtattccgaccaaagtgaccggtcaggcgctgactgtgaatgagaaaggcgaagatgtggttgttccggggctatttgccgttggtgaaatcgcttgtgtatcggtacatggcgctaaccgtctgggcggcaactcgctgctggacctggtcgtatttggtcgtgcggcaggtctgcatctgcaagagtctatcgccgagcagggcgcactgcgcgatgccagcgagtctgatgtagaagcgtctctggatcgcctgaaccgctggaacaataaccgtaacggtgaagatccggtggcgatccgtaaagcactgcaagaatgtatgcagcataacttctcggtcttccgtgaaggtgatgcgatggcgaaagggcttgagcagttgaaagttatccgcgagcgtctgaaaaatgcccgtctggatgacacttcaagtgagttcaatacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggaagaaggtcgcgacatgatgctgctggatgcgcttattcagctgaaagagaaagatcccagcctgtcgttccgccgctcctgccgtgaaggtgtgtgcggttccgacggtctgaacatgaacggtaagaatggtctggcctgtattactccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggttgtatgaatgtattctctgcgcatgttgttcaacctcttgtccgtctttctggtggaatcccgataagtttatcggcccggcaggcttgttagcggcatatcgtttcctgatcgatagccgtgataccgagactgacagccgcctcgacggtttgagcgatgcattcagtgtattccgctgtcacagcatcatgaactgcgtcagtgtatgtccgaaggggctgaacccgacgcgcgccatcggccatatcaagtcgatgttgttgcaacgtaatgcgtaaaccgtaggcctgataagacgcacaagcgtcgcatcaggcaaccagtgccggatgcggcgtgaacgccttatccggcctacaaaagaaatgcagaaaccgtaggcctgataagacgcgcaagcgtcgcatcaggtaaacagcgccggatgcggcgtgaatgccttatccggcctacaaaagaaatgcaggaaatctttaaaaactgcccctgacactaagacagtttttaaaggttccttagcggacgcagaaaacacgacaagtccgcaacaagtgaaccccggcacgcacatcagatatgaaatgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacatcaccagcaccgaagaaaaacgctggatccaacagcgtatcgagtctggtcgcgcgactttcaatagcgaagagaaaaaacgcttcttaagcgaactgaccgccgctgaaggccttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagtttgccggtaaacataaagaacacctcggcacgggcgacgtgaaataccacatgggcttctcgtctgacttccagaccgatggcggcctggtgcacctggcgctggcgtttaacccgtctcaccttgagattgtcagcccggtagttatcggttctgttcgtgcccgtctggacagactcgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggcttcaccacctctaatccgctggatgctcgttctacaccgtactgtactgatatcggtaagatggttcaggcaccgattttccacgtaaacgcggatgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacgccgcgcaaaatctatgctgacaagctggagcaggaaaaagtcgcgacgctggaagatgccaccgagatggttaacctgtaccgcgatgcgctggatgctggcgattgcgttgtagcagagtggcgtccgatgaacatgcactctttcacctggtcgccgtacctcaaccacgaatgggacgaagagtacccgaacaaagttgagatgaagcgcctgcaggaactggctaaacgcatcagcacggtgccggaagcagttgaaatgcagtctcgcgttgccaagatttatggcgatcgccaggcgatggctgctggtgagaaactgttcgactggggcggcgcggaaaacctcgcttacgccacgctggttgatgaaggcattccggttcgcctgtcgggtgaagactccggtcgcggtaccttcttccaccgccacgcggtaatccacaaccagtctaacggttccacttacacgccgctgcaacatatccataacggccagggcgcgttccgcgtctgggactctgtactgtctgaagaagccgtactggcgtttgaatacggttatgccaccgcagaaccacgcaccctgaccatctgggaagcacagttcggtgacttcgccaacggtgcacaggtggttatcgaccagttcatctcctctggcgaacagaaatggggccggatgtgtggcctggtgatgttgctgccgcacggttacgaagggcaggggccggagcactcctccgcgcgtctggaacgttatctgcaactttgcgctgagcaaaacatgcaggtttgcgtaccttctaccccggcacaggtttaccacatgctgcgtcgtcaggcgttgcgcgggatgcgtcgtccactggtcgtgatgtcgccgaaatccctgctgcgtcatccgctggcggtatccagcctcgaagaactggcgaacggcaccttcctgccagccatcggtgaaatcgacgagcttgatccgaagggcgtgaagcgcgtagtgatgtgttctggtaaggtttattacgacctgctggaacaacgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccagcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgcgggtaaagaaaccagcgcgaaatctgaagagaaagcgtccactccggcgcaacgccagcaggcgtctctggaagagcaaaacaacgatgcgttaagcccggcgatccgtcgcctgctggctgaacataacctcgacgccagcgccattaaaggcaccggtgtgggtggtcgtctgacccgtgaagatgtggaaaaacatctagcgaaagccccggcgaaagagtctgctccggcagcggctgctccggcggcgcaaccgaccctggctgcacgtagcgaaaaacgtgtgccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcattcgtctgggctttatgtccttctacgtgaaagcggtggttgaagccctgaaacgttacccggaagtgaatgcgtctatcgacggcgatgatgtggtctaccacaactatttcgacgtcagtatggcggtttctacgccgcgcggcctggtgacgccggttctgcgtgatgtcgataccctcggcatggcagacatcgagaagaaaatcaaagagctggctgttaaaggccgtgacggcaagctgacggttgaagatctgaccggtggtaacttcaccatcaccaacggtggtgtgttcggttccctgatgtcaacgcctatcatcaacccaccgcagagcgcaattctgggtatgcacgctatcaaagatcgtccgatggcagtgaatggccaggttgagatcctgccgatgatgtacctggcgctgtcctacgatcaccgtttgatcgatggtcgcgaatccgtgggcttcctggtaacgatcaaagagttgctggaagatccgacgcgtctgctgctggacgtttagtagtttaagcttcacctgcactgtagaccgacgtggatagggtgtcggtctacggtttaaaagataacgattactgaaggatggacagaacacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagatatccgtgcttttgcagaaaactggctgggcaagcgtctggtaacgtatcaaacagatgccaatggccaaccggttaaccagattctggttgaagcggcgaccgatatcgctaaagagctgtatctcggtgccgttgttgaccgtagttcccgtcgcgtggtctttatggcctccaccgaaggcggcgtggaaattgaaaaagtggcggaagaaactccgcacctgatccacaaagttgcgcttgatccgctgactggcccgatgccgtatcagggacgcgaactggcgtttaaactgggtctggaaggtaaactggttcagcagttcaccaaaatcttcatgggcctggcgaccattttcctggagcgcgaccttgcgcttatcgaaatcaacccgctggttattaccaaacagggcgatctgatttgcctcgacggcaaactgggcgctgatggcaacgcactgttccgccagcctgatctgcgtgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttcctggacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaattgataaaaacaccaaggttatctgccagggctttaccggtagccaggggactttccactcagaacaggccattgcatacggcactaaaatggttggcggcgtaaccccaggtaaaggcggtactacccacctcggcctgccagtgttcaacaccgtgcgtgaagctgttgctgctactggcgctaccgcctctgttatctacgtaccagcaccgttctgcaaagactccattctggaagctatcgatgcaggcatcaaactgattatcaccatcactgaaggcatcccgacgctggatatgctgacggtgaaagtgaaactggatgaagcaggcgttcgtatgatcggcccgaactgcccaggcgttatcaccccgggggaatgcaaaatcggtatccagccgggtcacattcacaaaccgggtaaagtgggtatcgtttcccgttccggtacgctgacctatgaagcggttaaacagaccacggattacggtttcggtcagtcgacctgcgttggtatcggcggcgacccgatccctggttctaactttatcgacatcctcgaaatgttcgaaaaagatccgcagaccgaagcgatcgtgatgatcggtgagatcggcggtagcgctgaagaagaagcagcggcgtacatcaaggagcacgttaccaagccagttgtgggttacatcgctggtgtgactgcgccgaaaggcaaacgtatgggtcacgcaggtgcgatcattgccggtggtaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccctctacaggaggggcgaagggctgtcggtttcgacatggttggccatcttatgatggccttttttattcgggcactaatctgaaaagtttgcccactgcttttctcccatcttctgcgcaataatgcccggcaaaatatcccctctccgttctgtaaaagcatttatacaagaagaaaattgttctgccggttgctctggctctgatgggtgtaaattcggacgtttatgcggccgatgtaaatatcgatattttaagtgcgacagtgaaagataaacgcattgagggagtatcggtgacgctgcaacgcaatggcgcacaatctgtttctggaaccacaaatgcatcgggcagcgttaatctgggttctacatttgctgatgatcaagatgctttattgatcgtcaaaaaagagggctattctaatctggtggtcaaatgttcgtgtgctggcatgacttatgcgattagtccggcaatgactagtctggatggcatgcgtgtagttttgagctggggcgaaaagccttttgatcttgattcacatttgatcttccctggcggacatatctattttgatagtaaagaggggactgatgctaatctggatgttgatgatacggatagctatggatcaaaaactgtcactatcagcaaaaagcattttggcgaaagttacatctatgccgtgcaggactatagcaataaagggctgcccaacagtaattatctctctgccagtaaggcaaaagtgtttgtttatgtagggagctccctggtacgtagttatagtgtccctgctggaaaacgagggaacatctggaccgtgtttaaactcaatccaaacggcgagtttgaagatatcaactctgttaccagcgccaattttaacgacaccacattagacgtcagggatttagccactgtgataatgcctgcgacggactcttcagctccggcttcgcctgcgatgcaaaacagtggagatactcaactggcaagaaaatataatcgcgaaggtgaagctgtttataaaaccggtcaacttgagcaagccattcaactcttccaacaggcaacagaattagacggcaattacggacaggcatttagtaacctggggctggcgtatcagaaaaatggcaacatcgcggaagcaatttgggcaaatcgtaaagcgatctcgttagccagtggagcaaatgcggcgacaacgcgcgctaactcctattataacattgccaaaatttatgaaactgctggacaggacgctgatgcattgcagcattatcaactcgctcttcacgatgccattttataaaaatgaaagtggaatcatattttttaattttatatgcttgcttgtttttctggtcaagttatccatcattcactgttttattatcttaaggatgatggaaatagaaggttttttaatgataataaaacatattcttatgttatttaatcacgaattttttaatatgattatgtatcaatacgttatattacccgatgtgctactgaattatcgactattactttaatatttagtgatcgtaaacatggttctccagattactaaatttctggcatcttacaatatcatcatcttcaaatagttaaattaagattatggcactgccaaaacagataaattgaagcagtctggtagatattgcagaacaaccttgattccaacggcgaaatcatgtttatcctccaggttgccgcccatatggagctgaatatcattcagtccacgcttgatgagttgatatcgctatatccatagatagggtagctttttacacgagagtgtccggtgttttctaacggctggcaatcattccgttttgttgtttcgtatcactgctataacaatttctcttgaatttcaatctttgagcgaatcattgaatacagatcgggaaatattaataccatatatattttattttgaaaatccttgttccatctgactatacctaaggtatctatttcttcttgtgattattaccaatgaaacaataagtgacggatttacagtacgttgctcataaagacaacaatcaattaacggtgataaaaatatgttatgtaaaatggcaataaagtagctactctaactaattagtattataaaaagtcgataaagcggctctgttaaataaaatactggttttttatctatatatttccatgtgggtaattttactgtgctattttgttacaataaattaacaataaagttaccagtggttcatgattcacacataattaacatatgtggttgattttgatataaatcaatttttaattcttgaaaaaaatctgcaaaacacgataaattgttgtagatcaaattggtgagatcgtgacaatttcgctataaattgatcactgtcgaaaaatgcaaatttgctcaataaaaacctgtttattgtaaggattttgcggcgtaatataattacgggatcaatttggtttattcattaacacatttgtaacttttttatcattgtcttttcctcttttgatgaaatggcaacgatagaggcgagcaaataattttgtattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctttttgtgccactgacgctcggtatggcgttcctgctggccattatggaaacggtctacgtcctttccggcaaacagatttataaagatatgaccaagttctggggcaagttgtttggtatcaactttgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcaaacggctggatgcaaaacccaatcgcgtccgatttcaactttgaaactatgcgtatggagatggtgagcttctccgagctggtgcttaacccggttgctcaggtgaaattcgttcacaccgtagcttctggttatgtgactggcgcaatgttcatcctcggtatcagcgcatggtatatgctgaaaggtcgtgacttcgccttcgctaaacgctcctttgctatcgctgccagcttcggtatggctgccgttctgtctgttattgttctgggtgatgaatccggctacgaaatgggcgacgtgcagaaaaccaaactggctgctatcgaagccgagtgggaaacgcaacctgcacctgctgcctttactctgttcggcattcctgatcaggaagaggaaacgaacaaatttgcgatccagatcccttacgcgctgggcatcattgcaacgcgttccgtggatactccagttatcggtctgaaagaactgatggtgcagcatgaagaacgcattcgtaacgggatgaaggcgtactctctgctcgaacaactgcgttctggttctactgaccaggccgttcgtgaccagttcaatagcatgaagaaagatctcggttacggtctgctgctgaaacgctatacgccaaacgtggctgatgcgactgaagctcagattcaacaggcaaccaaagactccattccgcgtgtagcgccgctgtactttgcgttccgtatcatggtggcgtgtggcttcctgctgctggcaatcatcgcgctctctttctggagtgtcatccgcaaccgcattggcgagaaaaaatggctgctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcgatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccatcgcaccacactgggacggtaaccaggtttggctgatcaccgcaggcggcgcactgtttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtgattggtgtagcgttcggcaacctgttgcagggcgtaccattcaacgttgatgaatatctgcgtctgtactacaccggtaacttcttccagctgcttaacccgttcggcctgctggcaggtgtggtgagcgtagggatgatcattactcagggcgcaacctatctgcaaatgcgtaccgtgggcgaactgcacctgcgtacccgtgcaacggctcaggtggcggcactggtgacgctggtctgcttcgcactggctggcgtatgggtgatgtacggtatcgatggttatgtcgtgaaatcgacaatggaccattacgcagcctctaacccgctgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtattctcctccctgacgctggcctgcatcatcctgactgccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgagcacgtcgaatcaggcaaagccggtcaagaagacatctgatgagtaagattatcgcaaccttgtatgcggtaatggacaagcgccccctgcgggcgctttccttcgtgatggcacttctgttagcaggatgtatgttttgggacccatcacgtttcgccgcgaagaccagtgaactggaaatctggcatggtttactgctgatgtgggccgtctgtgctggtgtgattcacggcgtgggctttcgtccgcagaaggttctctggcaagggattttttgcccattgcttgccgatattgttctcattgtcgggctgattttcttcttcttttaaatcagaattctctttaaaaatttatgggccgagtcaggcccataaatttttacgctcccttaacttgccctcattcccaaacctcaatcgcgcgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcatttcagtcaacaggcgctgatggctgaacgcattgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgttgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcctgggccattattatccagcggacccgtattcttaatgcagcagcgcgcgaagccgaagcgtttgaagataaattctggtctggaatcgaactctctcgcctctatcaagagagccaggggaaacgggataatctgagcggttcggaacaaatcttttacagcggcttcaaagagtttgtgcgcctgcatcgtgccaatagccatgcgccggaagccgtagtggaaggggcgtcgcgtgcgatgcgtatttccatgaatcgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgacggcaattggtttgttcgccgcaattccggcggtaatggcttataaccgcctaaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgtctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgtatgcaaagccaggaatcaagcgcgaagcgttctgatgagcagcgcaagatgaaggagcagcaggctgctgaagaactgcgtgagaaacaagcggctgaacaggaacgcctgaagcaacttgagaaagagcggttagcggctcaggagcagaaaaatcaggctgaagaagccgcaaaacaggccgagttaaagcagaagcaagcggaagaggcggcagcgaaagcggcggcagatgctaaagcgaaggccgaagcggatgctaaagctgcggaagaagcagcgaagaaagcggcggcagacgcgaagaaaaaagcagaagcagaagccgccaaagccgcagtcgaagcgcagaaaaaagccgaggctgctgctgcggcgctgaagaagaaagctgaagcggcagaagcagctgcagctgaagcaagaaagaaagcggcaaccgaagctgctgaaaaagccaaggcagaagctgagaagaaagcggctgctgaaaaggctgcagctgataagaaagcggcagcagagaaagcggcagccgacaaaaaagcagcagaaaaagcggctgctgaaaaggcagcagctgataagaaagcagcggcagaaaaagccgccgcagacaaaaaagcggcagcggcaaaagcagcagctgaaaaagccgctgcagcaaaagctgccgcagaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaagctgcgttggcagcagctaaacttgcgaagatcccgaaaccaccaagccaggcagtatatgaagtgttcaaaaacgcgccattggacttcaaaccgtaatcgcgatgttgactgttccgacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgtgctcgtctgccacagcagccgggtagtgcgcaggaagtacaaccagctgcatggtccgcgctgggcattgacgctgtggttgtcggtcaggtcactccgaatccggatggttcttacaatgtcgcttatcaacttgttgacactggcggcgcaccgggtactgtacttgctcagaactcgtacaaagtgaacaagcagtggctgcgttatgctggtcataccgccagtgacgaagtatttgaaaaactgaccggtattaaaggtgcgttccgtacccgtattgcctacgttgttcagactaacggcggtcagttcccgtatgaactgcgcgtatctgactatgacggttacaaccagtttgtcgttcaccgttcaccgcaaccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagcctgaacctgtacgtaatggatttggcttctggtcagatccgccaggtaactgatggtcgcagtaacaataccgaaccgacctggttcccggacagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaacggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacacgcaaacttcctgcgtagcaacccgtcttacaaagtcaccgtagaaggtcacgcggacgaacgtggtactccggaatacaacatctccctgggtgaacgtcgtgcgaacgctgttaagatgtatctgcagggtaaaggcgtttctgctgaccagatctccatcgtttcttacggtaaagaaaaacctgcagtactgggtcatgacgaagcggcgtatgccaaaaaccgtcgtgcggtactggtttactaagagaattgcatgagcagtaacttcagacatcaactattgagtctgtcgttactggttggtatagcggccccttgggccgcttttgctcaggcaccaatcagtagtgtcggctcaggctcggtcgaagaccgcgtcactcaacttgagcgtatttctaatgctcacagccagcttttaacccaactccagcaacaactctctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgtggcggcatcaacgacgccgacagctgatgctggtactgcgaatgctggcgcgccggtgaaaagcggtgatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtattattttgcttcggtagtgaaaaactatccgaagtcaccgaaggctgcagatgcgatgtttaaagtcggcgtcatcatgcaggacaaaggtgacaccgcaaaagcgaaagccgtataccagcaggttatcagtaaataccctggtactgatggcgctaaacaggcgcaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccaaaagcaacgaaaaagtgggtcgttagctcagttggtagagcagttgacttttaatcaattggtcgcaggttcgaatcctgcacgacccaccactaacatagttagttgtagtatccagcgcagtatcgggtgattagctcagctgggagagcacctcccttacaaggagggggtcggcggttcgatcccgtcatcacccaccaccgggtcgttagctcagttggtagagcagttgacttttaatcaattggtcgcaggttccctggatctgatttcaggcgttgggtgtggatcactattgcaccgttcgtgacaatagttaacattatcgaaatcgcatgcttttttgtaaccgatatcattaataccgttttgcttttgttcgagagcatttttcactgcgagcagaagaggcgcaaagtcaaaataagcaggaagtgcaaaactacaatagctcttgtgcttcaagaaaaagcttcttgcgctctctgctgtcattgcggtaatcaatgtcatgaatactaaccctaattattacttttgagtctctattaaacactcctttgaacttaatgtcttatgttgagccactaaaacgcatcaatggtcacaattctgctcatcagttttcactcaatagtatcagagatatactattacccttcttacaacgcttatttattggccaaccatcatcccattgataaatgatctatcaatgggatgatagaaccgcttttattcgaagcgttgttcgcgcatctcatcctcctgctgctcttgcaacttttcatgttctatccaatcgtttaatttctcggaaacaattctagctgccgcagcaatatctgtacgctcatgctctattaatctactaatagtatttgctctgggttgcattacgttaactcgacttccccaccaagatgtcggtgttacgcgataagcgaattcttccagtacggcctttggcacaggagctgcttcaaggaagcgaatcgctgaaacctgcattgtgaccttatccaaatcatcccccacagaccaaaggcggataccctttgcgagaggtgcccatacattaatatcgtttcgagtaagacaccattcgatcaatacattcacgtcgatattcgcgataggggactctgtcacatcatcataatggataaaatgaatacgtcgttgttgctgttcttctgtcccttcaaaaatacgagagaggaacgcttctggcattgatgccgcagtcatctttatagtgtcttcaaacgaatgaatacagccatactgttcatcaacaacagcaaagatcgtatttaaccactctaacttccccgcctcgttgccttcgagacgcaatatggcaccaacaacacattccatgccgtaatccattcccccagcggaatcattgtgctctcttttgaacctctggattgcagctttcaatcctatttgaagcagatcaaagccaagagtactcgaaccgtctttctggtcacttaacttcatgcttaaagcttccaaaataacatcatcgccatttggcatacttaaaagcctgtgagcaagatcaacaatgcgcggctctggcaaatgagcgtattggtctccccaaagaatttgtccatacattgacggcatgatgtcggggtcatctaaaagagccaaacagcgatccaagtcagtttcagtgaattctcgccaaggatgtaaataaacaattccgtatcgcaactcaggatgacgcacacattgatcgagaaattcttgggctaatattgaatcaatagtatctgtctcgtcgataaagccacggataactgcaaaatccttttgagaaccggtttgtatatccaaataagcaacgagttgttgccaacactcccgtaggtcaagtgcccctcttgctaaaccttgaccaaatttaacacggtagggcatcccccccaccaagaacagattaggccccaactcatcaagcgtatgctgagatgacgcgaaatcctgccccaattgataagctttagagtcaaggtatgtcctaagattagcgaacttattaggttcatcaggagaagtatcggcactaaatgccaaataatcgcgtccgttacttaatacataagccattatttccggaaccaagtcatgtggttctaactcactctccagagcgacaagatcgcttggcaacggctctaaatcttcgatatctctgcgcttggtgtaatcaaaatatatcgttgaacgaacggccttccatccttcaacccacggatagtaagaatgtaatttgtgagcagcatcaatgagcattgtcctggcagcctcttgacgccatattgatcgaaaagccctcgctaaaagctgccgcgcagtttcctcaaccgcaggaattccgcaagttcctgcattaaccgcaacttcaatgaatgcactacgccattcaacaagttcttcataggttggttgaaaaccataatctcttggtcgtgcaccaaactcattagccccgaaccccgtccaaggtgggccgctgagggctgttgaaagcatcataaggcccaattctttgcgtccaacgacgtctgatgaaaggcattgtttcaaaattgcaaggcgctggtctaaagaggcctgtgtaccagacaggtatggctgataaagcctcttgatcttaccccgtacagagtcatggttgttgttttcaacctcataatctaccgcatgaattagcagcctgacgcaacgttcaaaagtttccggttcatatgccaacgattgcaggagattgaacatagttgtccgtcgtagactgtaacgccgttccatacctttaaagtcagatgaagtaagctcttcttcaatcctgttgagaagtgtttcaggcgcaaccggaccgatgtatgccaacatttgtattgatgcatcatccaactcagttcctcgtccaagcaaatctcctggttgaagccacgcttcaacgatttctttcgctacagcgtgttcatggagcaatcctagccggtgtgcgaatgatattaataaacgttggcgaccgggagcttcaaaggtgtctctgagttcatgaacggggatgctatcaagtgccgatgcagctagcttgtttgcaatagcatgaggtagaacagcccgccaattagctcttttctggataacgtgacggttcagtaaattagtaactgttttgaataactgcctgtaggagtacccgccgagtgagcctaacgcctccaattcgttaatcccgccttcactggttgagatggagaaggaatacactaaggacaatatttcagcttgttcccgcagatcatcatcgggatcattacgctgctcaaaaaggcggttaaacaactgtgcatcagacaattgagctagactttcaccctcttctaccctctctgctattgccaaggatacacgtgcattcccatcagcaaacgctgctattctacgggcattgtgatggcctatacgggggaagcgacgaatcaaaagctgttcagctacctccggtccaaacgcctctatgcggattacctcggttgtttgcggtttatcgtccctaatatcgtattcgatggtaataagtcttaccttgttacctacggctgatatcttacctgccaataaagagtgtagtgctgatgggcaattatcgaggatcataatagctcgtcgatcttcgacaataagccgctccagcatagccgttgccgagggggctgggtcagcacctgtatcaacatagattacagaggttctatctagagggtcagatccaaccgattcatcaaaaagtgcctgaacgatccgagtcttacctacaccagacaatcctgttatgcgaatagcttttttagtagaacggattagttctcgcatcggattgatagcatcttcaatgctaagcttctgcccttgccctgatggaagagtgaccgtgactccaggagctaagattagagtgtctacgacgccattgggaggattactccacgcaccgtatggctgccagcctgaatatccctgtccgagtatcccttttacccacaacataactgacggatgctggcgtaaccattgagtcagtttcgagcgatcaaagaagtcgagatggatattgccattatttggctcatccttaactgcttcctgcattgcttgcaggcgtttcatcttagaaataggagaacaatcatcactgaggcagacaattacgtatcctcctcttttagaaacttgctcagagattaacggtagtaatccttgttcagtttccatttcattcttgatcgcggacgcactcatcgaaggcttcttggcctgaaagatcgtgtcgggcctctcgataaaccctgtacttagtttgtcgataggaacctgaacatgaacgtcaattcctccgtctggtgcattgatggaaccagaccaattaacccatgcgggactgtggccatgagctgctacctctgcctcagcaagacgagcagtcaactcttcaagttgactatcggtgagtcggagtaattcatctttctcaatgtcaaagatcgccacatccaaaccttagtaaaattattacggccacagtcagatttagcctcctagtctaactaaagttgaaagagttgtccgctgaactgcccataaccatagaaaaacgttgaagttattgggaagcgtcggcttaggcaatatcgttaatcatgcccgcaactggcttaacgccagcatgcagatgggatttagctctaatcttcaatgaatgacggtctaaactgactcaggtaaagggggaggcatctacctcccctgtgatttgctcttactgtgatagttccttttcactcagaaaacgagcacgacggttacaggtcacttttgttctggcttgccgaatgcttgatttagccaacattgcaggattaacaaagtgttcatctaagcattgtcgggcaatcgcgaagtcgtaggctaaactcaactctcgcattacattacccgcctgaactcttgctcctcgttcaacaatactgttaaccaactccaccacatccttacgcgtaacagccatagcttccatatgccccagcactctgatggcatcgccttccagagttctccggcactctttctggcctttaactttgcgtgcgccacggatcagcttaccatcagagtctttacggtcctcaatcctctccgtcagatataactcgactacatctttgactgttacaggcttctgcttaactttctgcttttcgagtttaagctgcttcttttcctcatccagctcagttctgggacatcgcccctgctttctgattatcttcagttcgtgtaacctaacgcgggcatcagccagagtggtcacaggataatggcctatcaagatctgtttatctttacctgttattggactggtatagcggtagaaaaatgtgcagattcccatttttccacgcgtaacacgaaggcctctattttcgcccgtatctgccagagtcatgccgagcttcatggtatctataccgcgagcggttagaggtttattaggttgtttttcagacacagaaactccatgtaactggttgatattaatgatgtaaatcttataagtgtaggttgttttcgaattcaggttatcaccagactcttacattgaaaacctacactttgacctacacttttttttgagatttggtgatttttcatgagacaacgtgacaccacaaaagattgtaaatctcttaaaaagtattgtttttcaatgaaatggaaatcataagtccatgagtacacctgaaaatttcgacgcccatacgcccatgatgcagcagtatctcaagctgaaagcccagcatcccgagatcctgctgttttaccggatgggcgacttttatgaactgttttatgacgacgcaaaacgggcgtcgcaactgctggatatttcactgaccaaacgcggtgcttcagcgggagagccaatcccgatggcggggattccctaccatgcggtggaaaactacctcgccaaactggtgaaccagggcgaatcggttgctatttgtgaacagattggcgatccggcgaccagcaaagggccggtcgagcgcaaagttgtccgtatcgttacgccgggcaccatcagcgatgaagcactgttacaggagcgccaggacaatctgctggcggctatctggcaggacagtaaagggttcggctacgcaacgctggatatcagttccggtcgttttcgcctgagcgaaccggcggaccgcgaaacgatggcggcagaactgcaacgtacgaatccagcggaattactgtatgcggaagatttcgccgagatgtcgctgattgaaggtcgccgcggcctgcgtcgtcgcccgctgtgggagtttgaaatcgacaccgctcgccagcaattgaacctgcaatttggcacccgagatctggtcggttttggtgtggagaacgcaccacgcggactttgtgctgccggttgtctgttgcagtatgcgaaagatacccaacgcacgaccctgccgcatattcgttctatcactatggaacgtcagcaggacagcatcattatggatgccgcgacgcgtcgtaacctggaaattactcagaacctggccggcggtgcggaaaatacgctggcttcagtgctcgactgcactgtaacgccgatgggtagtcgtatgctgaaacgctggctgcatatgccagtgcgcgatacccgcgtgttgcttgagcgccagcaaactattggcgcattgcaggatttcaccgccgagttacagccggtactgcgtcaggtgggcgacctggaacgtattctggcgcgtctggcgttgcgtaccgctcgcccacgcgatctggcccgtatgcgtcacgctttccagcaactgccagagttgcgtgcgcagttagaaaatgtcgatagtgcaccggtacaagcgctgcgtgagaagatgggcgagtttgccgagctgcgcgatctgctggagcgagcaatcatcgacacaccaccggtgctggtacgcgacggtggtgttatcgcatcgggctataacgaagagctggatgagtggcgcgcgctggctgacggcgcgaccgattatctggagcgtctggaggtccgcgagcgtgaacgtaccggcctggacacgctgaaagttggctttaatgcggtgcacggctactacattcagatcagccgtgggcaaagccatctggcaccgattaactacatgcgccgccagacgctgaaaaacgccgagcgttacattattccggagctgaaagagtacgaagataaagttctcacctcaaaaggcaaagcactggctctggaaaaacaactttatgaagagctgttcgacctgctgttgccgcatctggaagcgttgcaacagagcgcgagcgcgctggcggaactcgacgtgctggtgaacctggcggagcgggcctataccctgaactacacctgcccgacctttattgataaacctggcattcgcattaccgaaggtcgccatccggtagttgaacaagtactgaatgagccgtttatcgctaacccgctgaacctgtcgccgcagcgtcgcatgttgatcattaccggtccgaacatgggcggtaaaagtacctatatgcgccagaccgcgttgattgcgctgatggcgtatatcggcagctacgtaccggcgcaaaaagtcgagattggcccgattgaccgtatctttacccgcgtaggtgccgcggatgatctggcttccgggcgttcaacctttatggtggagatgaccgaaactgccaatattttacataacgccaccgaatatagtctggtgttgatggatgagattgggcgtggaacgtccacttacgatggtctgtcgctggcgtgggcgtgtgcggaaaatctggcaaataagatcaaagcgttgacgctgtttgctacccactatttcgagctgacccagttaccggagaaaatggaaggcgtcgccaacgtgcatctcgatgcactggagcacggcgacaccattgcctttatgcatagcgtgcaggatggcgcggcgagcaaaagctacggcctggcggttgcagctctggcgggtgtgccaaaagaggttattaagcgcgcacggcaaaaactgcgtgagctggaaagcatttcgccgaacgccgctgctacgcaagtggatggtacacaaatgtctttgctgtccgtaccggaagaaacttcgcctgcggtcgaggcactggaaaacctcgacccggattcactgactccgcgtcaggcgctggaatggatttatcgcttgaagagtctggtgtaataataattcccgatagtcttttgctatcgggaatattaacaacaactgacgaatcaaataaaaataccctgtataataggaaagcttattttacagggtaaaaccatgccatctacacgctaccaaaaaatcaacgcccatcactatcgccatatatggaccgttggtgatattcatggtgactatcaattattacaatcccgcttacatcaactctctttttgccctgaaaccgacttacttatttcggtaggcgataacatcgatcgtgggcccgagagtcttaacgtgctgcgcctgttaaaccagccctggtttatctccgtcaaaggcaaccacgaagcgatggcgcttgatgcattcgaaactggcgatggaaatatgtggcttgccagcggtggtgactggtttttcgatttaaatgattcagagcaacaagaggcaatagatctgttgctgaaattccatcaccttccacatattattgaaatcactaacgacaccataaaatatgtcatcgcacatgcagattatccggggaaggagtatcagtttggcaaagaaatagcggagagcgaattactctggcctgttgatcgtgtgcagaaatcacttaatagcgaattaaaaaaataaacggtgccgacttctttatatttggtcatatgatgtttgataacattcagacgttcgctaaccagatttatatagataccggatcgccgaaaagcgggcggctgtcattttataaaataaagtagtctcatgcttcttctgtgaagcatgagtaacccggcgttattgcaggtcattattcatttttcgctaccagcaaagagagatccagcttcgccagcgcgcggctggcactctccggcagaccgtcgtcagtaatgatctgatcaaactcgcttaatggtaacgccagccatgtcgccacctgtccatatttcgtcgcatcacagaccaaaactcgctggcggctggcactggcaatcgcccgtttcaccgtgactttatcttctgctggcgtagagatcccccgcacactccatgacgatgcagaaataaaagcctgatcaatcatcaggctacgcagcatggtcgcagcggcttccccaacacaggaacggttttcccgacacactgcgccgccagtgtgaataattgtgcaattactgttgtcgagcaagtagtccgcaataacgaagtcgttagtaaccactgtgagtggctccatgtgagtcagatgctgtgcaatcgctaacgtggtcgttcccgcatccagatagatacaacgtcccggctgaacaagacttgccgccagcttgccaatagccgctttttgcgtcattgccagcgcagtttttacctgatgagaaggttcatgcgccacgcgtcccggagactggacgcccccggacaccagcacaacggctccctgctgctccagtttttgtaaatcccgacgaatagtcatatgtgacacattcattctgtccgttagttcagcaatactgacaatgcctttttcagctaccatctcaaggatgatttggcgacgctctacgggtatcaacttttgctccttcctttgtcctgcggacattctacgctatttgcctgcgaaacgtgcgcggcgcaactaacgcttagttcacataaaataacacacaatgttaatttttgtgaatcagctcaccatatcgttatctttccgcgcttatattcacaacatcaaacaaaatatcacttaaattaacaaggagagcagatgaaaacgggatcggagtttcatgtcggtatcgttggcttagggtcaatgggaatgggagcagcactgtcatgtgtccgcgcaggtctttctacctggggcgcagacctgaacagcaatgcctgcgctacgttgaaagaggctggtgcttgcggagtttctgataacgccgcgacgtttgccgaaaaactggacgctctgctggtgctggtggtcaatgcgacccaggttaaacaggtgctgtttggtgaaaaaggcgttgcacaacatctgaaacccggtacggcagtaatggtttcttccactatcgccagtgctgatgcgcaagaaattgctaccgctctggctggattcggtctggaaatgctggatgcgccggtttctggtggtgcggtaaaagccgctaacggtgaaatgactgtcatggcctccggtagcgatattgcctttgaacgactagcacccgtgctggaagccgttgccggaaaagtttatcgcatcggagcagaaccgggactgggttcgaccgtaaaaattatccaccagttgttagcgggtgtacatattgctgccggagccgaagcgatggcgcttgcagcccgtgcggggatcccgctggatgtgatgtatgacgtcgtgaccaatgccgccggaaattcatggatgttcgaaaaccggatgcgtcatgtggtggatggcgattacaccccgcattcagccgtcgatatttttgttaaggatcttggtctggttgccgataccgccaaagccctgcacttcccgctgccgttggcctcaacagcattgaatatgttcaccagcgccagtaacgcgggttacgggaaagaagacgatagcgcagttatcaagattttctctggcatcaccctaccgggagcgaaatcatgatcaagattggcgttatcgccgatgattttaccggcgcgacggatatcgccagttttctggtggaaaacggtctaccaacggtacaaattaacggtgttccaacaggtaaaatgccggaagcaatcgacgcactggtgatcagcctgaaaacgcgctcctgtccggtggttgaagccacacagcaatcgctggcggctctgagctggttgcaacagcaaggttgcaaacagatctatttcaaatactgctctactttcgacagtacggcgaaagggaatatcggcccagttaccgatgcattaatggatgctctcgacacaccgtttacggtcttctctccggccctgccagtcaacggacgtacggtttatcaggggtatttgttcgtaatgaatcaactgctggccgaatccggaatgcgccatcacccggtaaatcccatgaccgacagctatcttccccgtctggttgaagcgcaatccacagggcgctgcggcgtcgtttcagcacatgttttcgaacaaggtgtgaaagccgttcgtcaggagctggctcgcttacagcaagagggctatcgctacgcggtgcttgatgcgctgaccgaacaccatctggaaattcagggggaagccttgcgcgatgccccactggtaacgggcggttctggtctggcgattggcctggcccggcagtgggcgcaagaaaacggtaaccaggctcgcgaagcagggcgtccgctcgctgggcgcggcgtagtgctctccggttcatgctctcaaatgaccaaccgccaggtggcacattaccgtcaaattgcaccagcccgtgaggttgatgtggcacgctgcctctcaaccgaaactctggccgcttatgcacacgagctggcagagtgggttctgggccaggaaagtgtacttgctccactggtttttgccaccgccagcactgacgcattggcagcaattcaacagcaatacggtgcacaaaaagccagtcaggcagtggaaacactgttttctcaactagcggcgcggttagcagcggaaggcgtgacacgctttattgtcgcaggcggtgagacctccggcgtagtcacacagagcctgggcataaaaggttttcatattggcccaaccatttcccccggcgtgccgtgggtaaacgcactggataagcctgtctcactcgcccttaaatctggcaacttcggtgatgaagcctttttttcacgagcccaaagagagtttttatcatgagcgatttcgcaaaagtagagcagtctttgcgagaggagatgacgcggattgccagttcattctttcagcgcggatatgcaaccggttcggctggcaatctgtcgctgcttttacctgacgggaatttactggcgacaccgacaggttcatgcctgggcaatctcgatccgcagcggctttccaaagtcaccgcggatggcgaatggttaagtggtgacaaaccctcgaaagaggtgctctttcatctggcgctgtatcgcaacaatccgcgctgtaaagcggtagtgcatttgcacagtacgtggtcgacggcgctttcctgcctgcaagggctggacagcagcaacgttattcgtccgttcacaccatacgtggtgatgcggatgggaaatatcccgctggtgccttattaccgaccgggcgataaacgcatcgcacaggatctggcggaactggcagcagacaatcaggcttttttactggcaaatcatggcccagtggtttgcggtgaaagcctgcaagaagccgccaacaatatggaagagctggaggaaacggcaaagctgatttttattctcggtgaccgcccgatccgttatctgaccgcaggtgaaattgcggaattaaggagttaatgcaatgcctcgttttgcagctaatttatccatgatgttcaccgaagtgccttttattgaacgcttcgccgcagcgcgaaaagccgggttcgatgctgtggagtttctgtttccctatgactactccacccagcaaatccagcagcaactggtgcaaaaccatctgacactggcgctgttcaataccgctcccggagatattaatgcgggagaatggggattatccgcccttcccggacgtgagcacgaagcacgcgcagacatcgacctggcactggaatatgcattggcgctcaattgtgaacaagtccatgtgatggcaggcgtcgtgcccgctggcgaagatgctgaacggtaccgggcagtatttattgataatctccgctacgctgccgaccgctttgcgccacacggcaagcgaatattggttgaagcactcagccccggcgttaagcctcattatctcttctccagccagtatcaagcactggctattgttgaagaggttgcgcgagataacgtatttattcaactggatactttccatgcgcaaaaagtagatggcaacctgacacatttaatccgcgactacgccgggaaatatgcgcacgtacaaattgccggactacctgatcgacatgaaccggacgatggagaaatcaactatccgtggctgttccgcctgttcgatgaagtgggatatcagggctggatcggttgtgaatacaaacctcgtggcctcaccgaagaagggcttggctggtttgacgcctggcgctaattcgctcaatccctaattacaacgtacccatacatccccccatctacggatggggtaggttaactataactttcagacagggtttcccatgtccacaattacattgttatgcattgcgttagctggcgtaatcatgctgttgctactggtcatcaaggcaaaggtacaaccattcgttgctctgctcctcgtcagcctgttagtcgcacttgcggcgggtataccggcgggcgaagtgggtaaagtgatgatcgccgggatgggcggtgtacttggttccgtcactattattattggtctgggcgctatgctggggcgtatgatcgaacactctggtggtgcagagtcactggctaattatttcagtcgcaagttaggtgacaaacgaactatcgctgcgctgactctggcagcgttcttcctcggtattcccgtcttctttgatgtcggctttattattcttgcgccaatcatttacggttttgccaaggttgccaaaatatcaccactcaaatttggcctgcctgtcgctgggatcatgctcactgttcacgtggcggtaccgccgcatccaggccctgtcgccgcagcggggttactccacgcagacatcggctggctaaccatcatcggtattgcgatttctattcccgtagggattgttggctactttgcagcgaaaataatcaataagcgccaatatgcgatgtcggtcgaggtactggaacagatgcaactggctccggccagtgaggaaggcgcgacaaaattaagcgataaaataaatccaccgggcgtcgcgctggtcacctcgctaattgttattcctatcgcgattatcatggcgggtacggtttctgcaacactgatgccgccttcgcatcccctgcttggtacgctacagttgatcggctcaccaatggtagctctaatgattgcgctggtgctggcattctggttattggctttacgtcgcggctggagcttacaacacaccagcgacattatgggctctgcccttcccactgcggcggtagtgattttggttactggtgctggaggggtatttggcaaagtgctggtggaatcgggcgtcggtaaagcccttgccaacatgttacaaatgattgacctgcctctgttaccagccgcatttattatttcactggcgctgcgtgcatcgcaggggtcagcaaccgtagcaatcctgacaaccggcgggttactctcagaagcggtgatgggattgaatccaattcagtgcgtattggtgacgctggcagcctgctttggtgggcttggcgcgtcacatattaatgactcagggttctggattgtgaccaaatatctggggttgtcggtagcagacggtctgaaaacctggacagtgttaacgaccattctcggttttaccggattcttaattacctggtgcgtatggctcgtcatctaataatccagataagatatgatgtatcgtttaagtgcctgataaaggtgtaatgtatgccaatattaacctcggtaatatctcgctaccgaggttaattttcactttgcaatataattacaatctcttgcaagttgattttatcttagtaataagaaccgaccaatcttattgccatttcgatattagcaggcatagatgcgtcgtagccatacatatggccatatttcggacgtaatacttcagttactttcttaataattgcttcgcgctgggctcgcgcaaaatcagcatgattatttgccgttttattcataaatttaccaaaactttcttcttttctgactttaattgtcgtatccctaagatcattaagaaactggcgttgaaatttgaaatcatcgtgtgaaccaatattaccatgcccgccaataaaatatttccagtcaagcatttcaacctgacgcaaattactgtcatggtaaaccaacgtatccgatacggcgaagcccatcatcggcagttggtcaggattcaggagatccgggctgtgagctactttttcctgttttagcaaccatacagaatggtcgtcggtatgtcctgctttaacaaatcggtgtaattcaatggtctgcttttcaaatttaaactggtcatcttttttacttaaaacctgagtggcgacgggtaagcgactgttcataaattgcattttttcagcagtggctttactggcaataatacgcagattcacgccttctttcttcgcctcatcgttccaaaatggactatcgccaatgtgatccacatggtaatgagaataaaccagcgctgttacgggtaatggagtcacatcacgaattgcctgtaataaatatttaccgcgaccctccggagcatcaaacagcaaaacccctttatctccgacataaaacgtagtggaataaaaatagcgttgaacataataagttctctcgccaattttttgtaaaatataaggctgagacatatttctttcaaaaaggttattgagtttatcgcttggcgatattattttttccgctgaaggttcaacataacttgcattaactgtagacgaatttgcagtcgaaatttccgtttgagcaaaaacactaccagatataagagaagaggctagaattgtatatattttaatgccttgcatacgtagtcctttattaatgtgttgttgatttatagcatctctgaacagactgttattttagatattactacgttacgagattcatttttcttcgaatattatgtttatctcattcaaaaaatatgttcatcatttgatggtttaaataatatctgcaaggcataatactccacatctttaaaacctgcctcaaaaaatcattcattagtaaaaaggatatttatatgcaaaacatagctgtggtttattattcaggatatggtcacactaaactggttgctgaaaaagtggcacaaggcgcccatgcagatttaatttcgattgataacgaaggaaatatcactgagcaggagtgggaaaaactggacgcagccgatgccattatcttcggtgctcccacctatatgggcggtgcgccatggcaattcaagaaatttgctgatgccagttccaaagcgtggtttacacgtaaatggcaggataaagtcttcgggggtttcaccaacagcgccagcctgaatggcgataaacaagttacgctgatctatctgcaaacgctggcttcacagcatggcggtctgtgggtgagtttaggtcaggctcctgccaatgtgcttgcgtcaaccagggaagatgtaaacaatctgggcggttcagtcggtttgctggtgcaatctccagccgatgcgggtgcagaccaaatccctacgggcgatctggatacagccgtgaaatatggtgaacgcgtggcgacaattactgcgcgcttaaaatgatgattgccgaatgtgacgctgacgcgtctatccggtcttctacatctaaaaagtgccgtcccctggtcagtcagataaagttttaacgctgtatccgataacagttcaacatgtaccatgtaccaaaagaaaaaaggccagcctcgcttgagactggcctttctgacagatgcttacttattcgcggaacagcgcttcgatattcagcccctgcgtttgcaggatttcgcgcaaacggcgcaggccttcaacctgaatctggcgaacacgttcacgggtgaggccaatttcacgacctacatcttccagtgttgccgcttcgtaccccaacaaaccgaatcgacgtgccagcacttcacgctgtttggcgttcagctcgaacagccatttgacgatgctctgcttcatatcgtcatcttgcgtggtatcttccggaccattctctttttcatcggccaggatgtccagcaatgctttttcggaatcaccacccagcggggtgtctaccgaggtaatgcgctcgttaagacgaagcatacggctgacgtcatcaactggcttatccagttgctctgcgatctcttccgcacttggttcgtggtccagcttatgggacaactcacgtgcggttcgcaggtaaacgttcagctcctttacgatgtgaatcggcaaacgaatagtacgggtttggttcataatcgcccgttcgatcgtctggcgaatccaccaggttgcgtatgttgagaagcggaaaccacgttccgggtcaaacttctctaccgcgcggatcagccccaggttgccctcttcgatcaggtccagcaacgccagaccacgattgccataacggcgggcaatttttaccaccagacgcaagttactctcgatcatccggcggcgagaggcgacatctccacgcagtgcgcgacgcgcaaaataaacttcttcttcggccgttaacagtggtgaataaccaatctcaccaaggtaaagctgagtcgcgtccagcacacgctgtgtggctccctgcgataacagttcctcttcggccaaatcgttatcactgggttcctcttctactaaggccttttcgtcaaaaacctcaactccgttctcatcaaattccgcatcttcatttaaatcatgaactttcagcgtattctgactcataaggtggctcctacccgtgatcccttgacggaacattcaagcaaaagcctggttccgccgatttatcgctgcggcaaataacgcagcgggtttacggatttccccttgtaacgaatttcaaaatgcaagcgtgttgaactggttccggtgctacccatggttgctattttttgccccgccttcacttcttgttgttcccggaccagcattgtgtcgttatgggcgtaggcactcaggtaatcatcattatgtttgatgataatcagattaccgtagccgcgcagcgcgttaccggcataaacaacgcggccatccgcggtcgcgataattgcctgtcctttgctgcctgcgatatcaatccccttgttgcccccctcagaagcgccaaaggtttcgatcactttgccctcagtcggccagcgccaggtggagataggcgtactggttgatgtactgctgacagtcggctcggttgtgcttgctgttggtaccgttacaggcgctgtgaccgtggtcgcagttggcttgttgttcggcaacattttgttagcactctgttcacccgaagactcagaatacgtaattgtcggttgcgacgcaacagcaacggtggaattttgtgcaggcttgatcacaactccttgctctgctgcgtcggcctgggtaatggcatttccgcctgtgattggcgtaccggaagcattacccacctgtaaggtctgaccgacgttcagcgcgtatggtgcctgaatattgttgcgctgagcaaggtcacggaaatcgttgccagtaatccaggcgatatagaaaagcgtgtcgccttttttcacggtgtatgtactgccgctataactgcctttcggaatgttcccatactgacggttgtagacgattcgtccgttttccatctgtaccggctgctgagctactggctgcacaggctggatttgcggttgttgagtagcctgaatttgtggctgctgtaccggctgaatttgcggttgctgcgctgtagacgtcgtccccattttcggcggcggcgtaatcaacataccagaattggtatttgcgggcgcattgccattaacggagctgaccggtgccggtggatttgaagtgtcagaacagcctgccagccatagcgaaaccagtgacaatgccgcaatgcggcgaacggtgaattttgggcttcccgcgctcatttatcccccaggaaaaattggttaataaccagtgacataattaccgtgcaaggcaccatactgaacactggaaaagatgttcacgatacgctgacttgcggcaaaataaccaggaaaaatccaggtatttcctcacgttttaagccagctcacccttcactaaagggacaaagcgcacggcctccacggtatcgataataaattcgcctccccgacgacgcacccgttttaaatactggtgctcctcccctacgggtaagacgagaatcccgccttcgtccagctgcgtcattagcgcagttggaatttcaggcggtgccgccgtaacaatgatagcgtcaaacggcgcgcgtgcctgccaaccttgccatccatcgccatgacgggttgaaacattatgtaaatcaagatttttcaggcggcgacgcgcctgccactgcaagcctttaatccgttcaaccgagcaaacatgttggacaagatgcgccaggattgcagtttgatatcccgaaccagtgccaatttccagcacccgcgactgcggcgtcagctcgagtaattcggtcattcgcgccaccatatacggctgcgaaattgtctgcccctgacctatcggcaaggcgatattgtcccaggctttttgttcaaacgcttcatcaacgaatttttcacgcggcacggcggcaagtgcattcagcaccagctcatcctgaataccttgcgcacgtaattgatccagaagtgcttgtacgcgtctgcttaccattgcgtgccaactcccacgctgtttaaccagtctgaaaccacatcttgcgcgctatgcgcagttaaatccacatgcagcggcgtgatggaaacatagccctcatctaccgcagcaaaatcggtccccggaccggcatcacatttaccgcccggcgggccaatccagtacagcgtattgccgcgcggatcttgctgcgggatcacctgatctgccggatgtcgtgtaccgcagcgcgtcacgcgaatacctttgatttgatccaagggtaaatccggaacgttaatattaagaatacgcccggtgcgcagcggctctttacacagtgcgcgcaaaattgagcaggttaccgccgcggcagtgtcgtaatgtttatgcccgtcaagcgagacggcaagcgccggaaaacctaaatgacggccttccatcgcggccgctaccgtaccggaataaataacatcatcccccagattcggcccggcgttaattccggacacaacaatgtccgggcgcgggcgcatcagagcatttacgccaagatagacgcaatcggtcggggttcccatttgcacagcaatatcaccattttcaaaggtaaacgtgcgcagggaggattccagtgtcagagaattagaagcgccgctgcggttacgatcgggggcgaccacctgaacgtcagcaaactcacgcaaggctttcgccagcgtttgtataccgggtgcatgtaccccgtcatcattactcagcaatatgcgcataatcacctgttgtgttgataagttccctgacaacgctggttgcaaaacttcccgccggaagccagaaacggatttctacggtgacatcatcccaccagttccagcttaattgttgcggatacagcagcatcgctctgcgcgcggcttcaactttttcgcgcaccagtaaggtttgtaattcagtttcttcggcgacagctgcttgttcgaatgccagcgcttcacgctgagttccccactcgccactgcccggcaatgcggcggttatcatcagcactttatcgttgacgcgacgctgtaattccgccagttcttcggtggttgcgacaaaccagctaccacgtccggctaattgtagcgcatcgccgtcaacaacttgattaacgtctgcttttttgaggcgctcagcaacaatctgattaaacaacgcactgcgggctgccgacaaccaaaaactacgtttattgcgatcgcgcaccggagtattggtttgcgcccagcgcagcgcaccctgcaagttgctaccgccaatcccaaaacgttgggcaccgaagtagttcggtacaccttttacgcaaatatcgatcagacgttgttcaacgtcatcgcgattgctcacttcgcgtagtaccagggtaaaggcgttacctttcagcgcccctaaacgcagcttgcgcttgtgccgcgcatactccagcacctggcagccttccagttgaaaggcgctcagatcgggcatctctttgcccggcacgcgagcgcataaccactgttccgtaacagcatgtttatctttttgcccagcgaagctgacttcacgggcatgaattttcaggaatttcgccagtgcatccgccacaaaacgggtattgcagccgtttttgaggattctaaccagaatatgctcaccttcaccatcaggctcaaagcccaaatcttccaccaccacaaagtcttccggattggctttcagcagcccggtgccttgcggtttaccgtggaggtaagtgagattatcaaactcaatcattttgttgccttaatgagtagcgccaccgcttcacaggcaatcccttccccacgtccggtaaatcccagtttttccgtagtagtggctttcacgttaacatcatccatatggcagccgagatcttcggcaataaacacgcgcatttgtggaatgtgcggcaacatcctcggtgcctgagcgatgatagtgacatcgacgttgccgagggcataacctttcgcctgaatacgacgccaggcttcgcgcaacagctcgcggctgtcggcacctttaaatgccggatcggtatccgggaacagcttgcctatatctcccagcgccgccgcgccaagcaatgcatcggtcaacgcatggagcaccacgtcgccatcagaatgcgccagcagccctttttcgtaaggaatgcgtacgccaccaatgataattgggccttcaccgccaaaggcgtgtacgtcaaaaccgtgtccaattcgcattatgtattctcctgatggatggttcgggtgaggtaaaattcggccagcgccaaatcctccgggcgcgttaccttgatgttatccgcgcggccttcaacaagttgcggatgaaaaccgcaatattccagcgccgaggcctcatcggtaatggtagcgccttcatttagagcgcgcgtcaggcagtcatgtaacagctcacgagggaaaaattgcggcgtcagcgcgtgccataagccgttgcgatcaacggtatgagcaatggcatttttgcccggttcggcacgtttcatcgtatcgcgcaccggcgcagcgaggatccctcccgtgcggctggtttcgctcaacgccaacaatcgcgcgaggtcatcctgatgcagacaaggacgagcggcgtcatgcaccaatacccactgcgcgtcgccagcggctttcagacctgccagcacggaatcggcacgctcttcaccaccatcaacaaccgtgattcgtggatgattcgccagaggaagttgtgcaaagcggctatcgccaggacttatggcaatgacgacacgtttcaccctgggatgcgccagcagcgcatgcaccgagtgttcaagaatggtttgattaccgattgagagatattgcttaggacattccgtttgcattcggcggccaaatccggccgccggaaccacggcgcaaacatccaaatgagtggttgccatgttaattcccgggctgatttatcgattgttttgccccgcagactgtgcgcgctttgacgcgtcaggcaccagacgataaaacgtttcgcccggcctggtcatgctgagttcattacgcgcacgctcttcgagcgcctcctggccgccattgagatcgtcaatttcggcaaaaagctgatcgtttcgcgctttaagtttcgcgtttgtagcttgctgtgccgccacatcattattgacgcgagtatagtcatgtataccgttcttaccgaaccacagcgaatactgtagccagaccagaatagccagcaacagcagcgttagtttacccatcctgccccctgaaaaacggcatcttcatcccatgcatccgaagacgactctacatcctctgttggggataccgcgacaacgcgggcaaatgtaccacatttgtccattgttacgtatacccagggcgtgcagaacataatctcattattagttacggattgaattatgaacagaatagagaggaaagaacaattaacccagtagccacataaacagcgcaccaaacataatgccaaccgtcgccagagtgaaaacaatactgtagcgtagctttccgtccatcaatgaatgcagtgcaatccccaccaccactgcgacgggcatcagcgccagaaagaaaggccaggtgtagataaaaaagagcagcgtgttagagccataaatcaacatcggaattgccaacgcgcacagccacgataaaaaaccaaccacagcgcctggcagcgaccatgtggtgtcttcaacctcagtaaggccgtcgttatttgttaatgtaatgttgtggctgttacgcatatctgatcctgttactttgacgaaccgggcatgaaaacccggtggtgtctcaggatctgataatatcgttctgtctcaacagatctaataattgctgtaccaaatttgttactaattgttcaccattgagatgaatttctgccgattcaggcgcttcgtaaacggaatctattcccgtaaagttgcgcagttcaccggcacgcgctttcttatataaaccttttggatcgcgggcttcgcaaatcgccagcggcgtatcgacaaacacttcgataaagcgcccttctcctacgcgttcgcgaaccatctggcgttcggcgcggtgtggcgagataaatgcggtcagcaccaccagtccggcttcaaccatcaaattcgccacttcaccgacgcgacggatattctctttacggtcggcatcgctaaaaccgagatcgctgcataatccgtggcgaacgttgtcgccatccagcagatacgtactgacgccaagtttatgtaacgcctcctccagcacccccgcgacggttgatttaccggaaccagagaggccggtaaaccacagcacaacaccacgatgaccgtggtgctgttcgcgttgttgcggagttactgggtggctatgccagacgacgttttcgtcatgcagcgccattatttatctcccagtaaatcgcgcgcaccccaatgcgggaaatggcggcgaaccagggcattcaattccagttcgaatgcactgaattcagatggcgcagcagttgcctggctaactggttcgtgcaccataccggcacctacggtcacattactcaggcgatcgataaaaatcagcccaccggtaaccgggttttgctgataacgatctaacaccagtggctcgtcaaaggtgagatctaccaggccgatgccgttcagcggcaggttttcaacttcgcgttgggtaaggttattgatatcaacctgataacgaatgccatcaacacgagcacgcgtcttcttaccggcaattttgatgtcataactctggcccggggaaagcggctgttccgccatccataccacatccaccgacgcgctctgcacagccggtaacgcttcgtctgccgccagcagcagatcgccacggctgatgtcgatctcatccgtcagcaccagggtgatcgcttctccggcaaaggcttcttcgcgatcgccatcaaaagtcacgatccgcgcgacgtttgattccacaccagagggcagcactttgacacgttgcccgacttccacgcgaccggatgccagcgttccggcgtagccacgaaaatcgagattcggacggttaacgtactgcaccgggaagcgcattggctgagcatccaccactcgctggatctccacggtttccagcacttctagcagtgtcggaccgctgtaccacggcatactttcactttgcgaagccacgttgtcgccttccagtgcggagagcggcacaaagcggatatccagattacccggcagctgcccggcaaaagtcagataatcttcacgaatacgggtgaacgtctcttcactgtaatccaccagatccattttgttgatcgccacgaccagatgtttgatccccaacagtgtggagataaaactatgacgacgggtttgatcgagcacgcctttacgggcatcgatcagtaagatcgccagttcacatgtcgatgcgccagtcgccatattgcgggtgtactgctcgtgccctggggtgtcggcgataataaatttacgcttctcggtagagaaatagcggtaggccacatcaatagtgatgccctgttcgcgctcagcttgcaggccgtccaccagcagtgccagatccagcttttcgccctgggtgccgtgacgcttactgtcgttatgcagcgatgagagctgatcttcgtagatttggcgggtatcgtgtagcaggcgaccaatcagggtacttttgccgtcatcgacgctaccacaggtcagaaaacgcagcaggcttttatgttgttgcgcaatcatccaggcttcgacgccgccttcattggcgatttgttgtgcaagtgcggtgttcatcttaaaaatacccctgacgttttttcagctccatagaccccgcctggtcgcggtcaatcacgcggccctgacgttcactggtggtggaaaccagcatctcttcgatgatctccggcagtgtttgcgcatttgactccaccgcgccggtcagcggccaacagcccagtgtgcggaaacgcaccatccgttttttaatcacttcgcccggttgcagattgatacggttgtcatcaatcatcatcagcataccgtcgcgttccagaaccggacgttccgcagcgagatacagcggaacaatgtcgatattttccagccagatgtattgccagatatcctgctcggtccagttagagagcgggaagacgcggatgctttcgcctttgttaatttgcccgttgtagttgtgccacagctccgggcgctgatttttcggatcccagcgatggaatcggtcacggaaagagtagattcgctctttagcgcgggatttctcttcgtcacggcgcgcaccaccgaaggcggcatcaaaaccgtatttgttcagcgcctgtttcaggccttcagttttcataatatcggtatgtttcgcgctgccgtgtacgaatggattaatacccatcgccacgccttccgggtttttatgcaccagcagctcgcagccgtaggctttcgccgtacgatcgcggaactcatacatctcgcggaatttccagccggtatcgacatgcagcaacgggaaaggcagcgtacctggataaaacgccttgcgcgccagatgcagcatgacgctggaatctttaccgatagagtagagcatcaccggatttgagaattctgccgccacctcgcgaataatgtggatgctttccgcctccagttgccgcaagtgggtaagtcgtttttgatccataaccgttcctttgcaataccgctattttcttgccatcagatgtttcgactatagggagcgtaagagaacgaatgaaattaccaattagaatgagtagttccttaacggaataacgatttggcaaagctaatatcaaaaagtgcttaaggcaccggatttcgggcgtttaggaagatttgaaattgttttagcgcagcagcagtttcatactatggcggtaaaaaaatttgcatggtatttaaggactcactatgttttccgcattgcgccaccgtaccgctgccctggcgctcggcgtatgctttattctccccgtacacgcctcgtcacctaaacctggcgattttgctaatacccaggcacgacatattgctactttctttccgggacgcatgaccggaactcctgcagaaatgttatctgccgattatattcgccaacagtttcagcaaatgggttatcgcagtgatgttcggacatttaatagtcggtatatttataccgcccgcgataatcgcaagagctggcataacgtgacgggaagtacggtgattgccgctcatgaaggcaaagcgccgcagcagatcatcattatggcgcatctggatacttacgccccgctgagcgatgctgacgccgatgccaatctcggcgggctaacgttacaaggaatggatgataacgccgcaggtttaggtgtcatgctggaactggctgaacgcctgaaaaatacgcctaccgagtatggtattcgatttgtggcgaccagcggcgaagaggaaggaaaattaggcgctgagaatttactcaagcggatgagtgacaccgaaaagaaaaatacgctgctggtgattaatctcgataacttaattgttggcgataaattgtatttcaacagcggtgtaaaaacccctgaagcagtaaggaaattaacgcgcgaccgggcgctggcaattgcccgcagccatggaattgccgccaccacaaatccaggtttgaataaaaactatccgaaaggcaccgggtgttgtaatgacgcagaaatattcgacaaagccggtattgctgtactttcggtggaagcgactaactggaatcttggcaataaggatggttatcagcaacgcgcaaaaacagccgcattccctgcaggaaatagctggcatgacgtaagactggataatcaacagcatattgataaggcacttcctggaagaatagaacgccgctgccgtgatgttatgcggataatgctaccgttggtgaaggagctggcgaaggcatcttaatgggtttgaaatgattactcccttgcctgcaggaaatcaatgccaccagaaacagagtataaaaaagggtgcaggagaccaaaccatcacaattcagtacgcggggttttacccccgcgtggtggctacttcttcgattcgtaagcgagaactgccttaaactccataccacgttctctgatactcaactcacacaacgagtcgcctaccatcagcgtgaatcccagtactgtacaacacagtacgatgattgccacaagggcatattttgtcagcatgtcttgcctccctgcaaagaagagactaacattcgaattgtttgggttcgaacgtaagcctcaggttgatagaaatatcgccaggggcttttgtccgtctggaacctcgcgaatgctcaacgccagacggcctcaagcacccaacgccattctatgcctgttgattcttcctgcggcgttcacgtttaaaatcaggaatcctgctcgcaaaataaaaacgcccccatcttttcagacagaggcgtttaatttatccggcaatatttacccttcgtgtaatccacattcccttttcaagccaaagaaacgcgtttcttcttccgccatgccgggttcccatttacgggttgtatgggtatctcctaccgataaatatccttcatcccataatgggtgatatttcaggccatgtttttgcaggtactgatatatcgtccgattatcccagtcaataatcggcagcaccttaaatacgccacgctgaattgccagcaccggtaaattggcgcggctgccggattgttcacggcgcaggccagcaaaccaggtttgcgcattcagttctttcagcgcccggttcatcggttcgactttgttgatgtcattgtacttttcaatgccttcaacgccctgctcccacagtttgccgtagcgtgcttcctgccaggcggcgctttcggtagcacggtacactttcaggttgagcttgagtttgtccgttaactcgtcaataaagcggtaggtttccgggaacagatagccggtatcggtgaggatcactggaatatccgggcgaatctgattcaccaaatgcagactcaccgccgcctgaatgccaaagctggaagaaagtacatattcaccgggcagattatccagcgcccaggctacgcggccttcagcgtccagtttttccagttgggcgttagtttccgccagcgccagaatccggtctacctttggcagttcgttcagggcgtttagatcgagtttggacataagttcctcactgtttgccttgcctgatgcaacgcttacacatcttatcaggcctacaagaccgggctgatggttaatcccacaaatcgcgcgccggatcgagcaccgggcgaatgatgcccgcacgcaccgtaaagtcgccgaagccttcacccacttcgcgctctttcgcccagcgccctatcagttcatcaagcgacgccaggatttccggctcggtgatgttttctttatacatccgtgggatacgtgtcccaatgcggttgccgccaagatgcaggttgtagcgacccggcgctttccccaccagacccacttccgccagcatcgcgcgaccacaaccgttcgggcagcctgttacacgcatcacgatatgctcatcgctgacaccatgtttcgccattaaattatcgatgttgtcgataaaagacggcaggaaacgctccgcttccgccatcgccagcgggcaagtcgggaatgacacgcaggccattgagttttcacgctgcggcgtgacggcattcattaacccgctttctttggcgatcttctcgatcttcgctttctcgctttccggcacgccggcgatgatcagattctggttcgccgtaatgcggaaatcacctttgtggatcttcgcgatctccagcaagccggttttcagcggacgtcccggataatcaagaatgcgaccattttcgataaacagcgtcaggtgccagttatcatcaatgcccttaacccagccaatacgatctccgcgtccggtaaactcatacgggcgaatcggctcgaatttgatccccgcgcgacgttcaacttccgctttaaacgtctcaacccccacgcgctccagcgtgtatttggttttggcatttttacgatcggttcggttaccccagtcacgctgagttgtcacgacggcttccgccaccgccagcgtatgctccagcggcagatagccaaactcactcgccgtgcgggcgtaggttttcttgttgccgtgttcgatggaaagcccaccgcccaccagcaggttaaagcccaccagcttgccgttttcggcgatcgccacgaagttcatgtcgttggcgtgcagatcgatatcgttctgcggcgggatcactaccgtggttttgaacttacgcggcaggtaggtctgaccaaggatcggctcttcatcagtagtggcgactttttcctgatcgagccagatctccgcatacgcgcgggtacgaggcagcagatgttcagaaattttcttcgcccattcatatgcttccgcatgcagctgcgactcgtaagggttcgaggtgcagagtacgttacggttcatgtcgttggcggtcgccagcgcatcaagaccgaccgagtgcagcatctggtgcaccggtttgacgttctttttcagaatgccgtggaactggaatgtctggcggttggtcaggcgaatgctgccatagatggtgttttcaccggcaaatttgtcgatcgcctgccactgtttagtggtaatcaccccacccggcagacgacagcgaagcagcatcgcgtggcgcggctccagcttctgttcagcacgttcggcgcgaatgtcgcggtcatcctgctgatacatgccgtggaagcggatcagcaggaagttatcgcccttaaagccgccggtcagaccgtcgtttaaatcttccgcaatggtgccgcgcaggtagttgctttcaagcttcatgcgctcggcgtctgtcagttttccttcgaccactaaaggccctggatgtttttcgctcattagtagacatctcgctgataacggcgctctacgcgcagctcacttaaaaattcatccgccgcttcggtgtccatgccaccaaattcggcaatcacttccagaagtgcctgctcaacgtctttcgccatgcgattagcgtcgccgcagacataaatgtgggcaccgtcattgatccagcgccacagctctgcgccctgttcgcgcagtttgtcttgtacgtaaattttttctttttgatcgcgcgaccaggcgagatcgatgcgcgtcagcacgccttctttgacgtaacgctgccattccacctggtagaggaaatcttccgtaaagtgtgggttgccaaagaatagccagtttttacccggcgcttcgtcggcagcacgctgctgcataaaggcacggaacggcgcgatgccggtgccagggccaatcatgatcaccggggtttccggattggttggcaggcggaagttgtcgttatgttcgataaatacgcggacttcaccctcttcttccacacgatccgcgaggaagctggaggcaccaccggcacgggcgcggccttccacgtcgtaacgcaccacaccaacggtaacgtgcacttcgttctcgacttccgcctgcgaggaggcgatggaatacaggcgcggggtcagcgggcgcagcagattaatcagcgcttcggcatccagttgcgccggagagaaacgcaccatgtcgacaatcggcgtcgtcgcggcgtaatgctgtaacttcgctttatcgcccaccagcggcagcagcgtttcgctgcgggtaagcgtggcatagttctcaacaatgttggcggtgttgacggtcagttcgaagtgccactgtagcgcttcgttcagaggcaacgttttgccctcgacggtgacaggttcatcgcctttcagccacagcagttcgacaagttctttcaccagtgccggatcgttctgataccagacgcccaacgcgtcacccggctggtaacgcaggccagagtcacctaagtcaatttcaatgtgacgaacgtctttttcagagttacgcccggtaattttctggttaacagagaggctggccgccagcggcgcgtctttgctatacgggctggtgtggatttcatttaccgtgccagtagcgacggattgcgaaggtgccgcgacaggcgcacgcgatttaagcgcatcaaccacgcgggcgcgccactcgctggcagcagcctggtattcaacgtcggcatcgacacggtcgagcaggcgttcaccgcccagttccgccagcttactgtcaaaatctttcccggactggcagaaaaattcataagagctatcgccgaggctaaacacggcaaacgcggtgttttccagctttggcgcttttttggagaacaggaacttatgcagcgcgacggcttcttccggcggttccccttccccttgcgttgacgtcaccacgataagcagtttttcgctggcgatttgtttgaatttatagtcgcccgcgttcaccagcttaacgttcagttttgccgctaataaatcatcgcgtaatgcttcagcaacccgacgcgcattgccagtttgcgaggcggagataatagttatacccggcatttctgcggcgggcgctggcgtcgctgcaagcgcagcaggctgctggttgagcacgccccagaaatagccagaaacccaggcaagctgggtaggagttaaatcggtcgtggccgcctgaaggcgtgccagttgctccgggttcaacggaagcaacgcggaaggtgggacctgtgtcgtcatgcgttgttatgttccagtaagcaaagctgtttctgcgccctgtcagcgcccataaaacagaagagaaggtaaggttaacggggtaaacggtgtggattaaagacgggatagcgataactaataaccaaatcgactaacctgttttagcaatagtctttaacaacaaaatagattaaccaacccaatgaaaaacaaatgaatattgcccatcaataagataaatcagcgattttgcgcaacaaagtcgttttagataatgcgaaaaaacagcctttccggtactctacggcggttttatcgtcatgtagagaaattatgatgtccaccacgttatttaaagatttcaccttcgaagccgctcaccgcttgccgcacgtcccacaagggcataaatgtggtcgcctgcacgggcattcctttatggtgcgactggaaattaccggggaagtcgatccgcatacgggctggattatcgatttcgctgaactgaaagcggcgtttaaaccaacttatgagcgcctcgatcaccattatctcaatgatattccaggtctggaaaacccaaccagcgaagttttagcaaaatggatttgggatcaggttaaacccgttgtgccgctgttaagtgcggtgatggtaaaagaaacctgcaccgcaggttgtatctatcgcggcgaatgataagagtgtgtcggcggtcaatttcccttaagtaacgctatgttagggtgttgtgttctggatatctggggcatgacatggaagacgactgcgacattattattatcggtgccggaattgctggcaccgcttgcgcgttacgctgcgcgcgagcgggtttatccgttttgttactggaacgagcggagattcccggcagcaaaaatctttccggcgggcggctatacacccatgcgctcgcggaactcctcccgcaatttcacctgaccgcgccccttgaacgacgcatcactcacgaaagtctttctctgttaacgccagatggcgcaacgacgttttccagcttacagcccggcggtgaatcctggagtgtattacgtgcacgattcgatccgtggctggttgccgaagccgaaaaagaaggtgtcgaatgcatccccggtgcgacggtagatgcactgtatgaagaaaacggcagggtgtgtggtgtcatttgtggtgacgatattcttcgcgcccgttatgtggtgctggcagaaggtgccaacagcgtcctcgcggaacgccacgggttagtgactcgtcctgctggcgaagcgatggcattggggatcaaagaagtgctgacgctggaaccatccgctattgaagaacgttttcatctggagaataacgaaggcgcagcgttgttgttcagcggcgggatctgtgatgacttacccggcggcgcatttctttatactaatcaacaaacgctctcgttagggattgtttgcccgctctcctcccttacgcaaagtcgtgttccggcaagcgagctgctggctcgctttaaaacgcatccggcagtgcgcccgcttatcaaaaacacggaatcactggagtatggtgcgcatctggtgccagaaggtggcctgcgcagtatgccggtgcaatacgccggtaacggctggctgctggtgggcgatgcgttgcgcagttgcgtcaataccggaatttccgtgcgcggtatggatatggcgctaactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgccctggctggtatcgggtgtggcctgggttaatgcaggatatttcccgtgatttatgggatcaggggaatacacctgttccaccgctgcgacagttgctctggcgtcatttacgtcgtcacggcttgtggcatctgacgggcgatgttatcaggagtctgcgatgtctgtagcccgtaatctctggcgcgctgccgatgcgccgcacattgttccagctgactccgttgagcgccagacggcacaacggttgattaacgcctgtccggcaggtcttttttcgctcacacctgaaggtggcttacgtgttgattatcacggctgcctggagtgtggcacctgccgtttgctgtgcgacgaatcaacactacaacagtggcgctatccgccttccggattcggcatcacctaccgctttggataaataataaggataatttatgcccctcttacacctgctccgccagaatccggtgattgctgccgttaaagataatgccagcctgcaactggcaatcgactctgaatgccagtttatttccgtgttgtacggcaatatctgcaccattagtaatatcgttaaaaagattaagaacgccgggaaatatgcttttattcatgttgatttgctggaaggcgcgtcaaataaagaagtggtgattcagtttttgaaactggtaaccgaggcggacggaattatcagtaccaaagcctcaatgctgaaagcagcaagagcggaaggttttttctgtattcatcgactgtttattgttgattcgatttcgtttcacaacattgataagcaagttgcgcaatcgaatccggattgtattgagatcctgccaggctgcatgcctaaagtgctgggctgggtgacggagaaaatccgccaaccgctgattgctggcgggctggtgtgcgatgaagaagatgcgcgtaatgcgattaacgcgggtgttgtggcgctttccaccacgaataccggggtctggacgttagcgaaaaaattgctttgacgggatactcgtaacgagttgaatttgtgtgatttgtaggctgcacgccacatccgacattcagcgcctgatacgacgcttgacgcgtcttatcaggcttacaagtccccagcccagaaccgtaggcaggatcatccggcagcacgttattggcaatctgcgtgaatggttgtcaccagtgcctccagcaccgctttccagtcatcaaccacgccaacatctgcctgtgaaaataccgccgcgctggcgtcatgattaatcgccaccacaaacttgctattgcgtacgcccgccattaacgctgctgcgccggaagcgccaacaacaatacacacctcaggtgccagcagatgtccggaaataccaatcactttttcggcatcaacgccaccgttcatcactcgtgcccgactgtagcccacttcggctcccatcttttctgccagcatagcgatttcctggttatctgcctctccgccctgccccaccaccagcacccgtctggcctcagctaatgggtcacgggtaacatttttcagattttcgacgctgataagccagtctggaagcgcgccggggacaatgttcagttgctgcatcccagagggcaacgtggcgtttttatctgctcccgcctgacgtgccagcgaaaggcatagcgggcgtttttctgtttgcaacgtcgccgttagcgcatttccccagtgagatttgcgcacgcttgcggttgatatatcgaatgaaatcacctggcagatactggcgccatgtacacgccaggccagtcgggtagccagttcatcgccaaacgcgcccggaggaaagaggacaacctccgcaggcgttcgttgccactgttccaccagcgcatccagcacctgttccgcaatcatcggctgtggttctatttgccagtgtgccagggtacaaccgctgaaatcctgcgccgccagccagctcgctattgcggcatggtcctgatttattgtcacaattgcgatattcatggctgcatcctttggcgtaaatagtcctgccatagcttttgcgctttttctgctaccgtttgcccatcaatcagcgtcgctccgcgtcgttgctctgctcttgccagttgcagacactgcatcgctggcaattcggcagcaacagttttacggataatttctgctttccccgcagccattcgctggcgcattcccggtactggcaaggccacttcaccacactggcgcacggcaatcaccgcaggcaagcgaacccggcaacagcgcaacccatgttcagtacgctgttcgagggtgataaacggcgcgtcgagagtgaaacgctccacctgggtgaaacagggccagcccagcatttccgccagcaaaaatggcgtttgcccattctgcccttcgctgctttggcagccagtaattatcagctccagcggattctggtactgccattcggcaatatggcgagcgacaaattccggcgcaaagcgcagatctgccgccgtctccagcaatacagcttcctcaaacccaagagccataagatagcgcagccagtgcaacgcccgttcatcccccatgctcaacgcggttaaagacatcgacgtaccgttttttctctgcgtcaacagcagcgcggcggcagcctgttcatcagcaccgagtaaacttcgcagaagcgaaacatccggtccgctattaccctgagccgccgcctgccactctttttccgccagcattccggcatccggttcggctttaaacgctaacagaatgttcattcgcacctcctgcatttcccgccgccaccagcgggagtgctttggtttctggtgcccatagccaggtcacaacaaaaccaaccaacaacactgccgccaggagcaataaggtgacttgcattccccactgcgccagcacccacggcagcaggccagtacttaccgccgcgccaagtcgactcatggcggtggcaaaaccgacgcccagcgagcgaatgtcagtaggaaaactttccgcaggcaaaatgcccaccagattactgactgccgaaatggtggtgctgaagagaacaaaaagcagcagggttaatgaactgccggaaggcaaacaggccatcacgaccagcgttgccgccagcagcaaaaaacttcccagcaaaaatttgcgatgtgccagcaggtgcgtcagaactaatcccagcagcgcgcccacaattaacaacgcattaagcatcaggctagcggtcaacgcatcttccagaccaatagtttgggcgatagttggcagccaggtataaatcacaaaccatgggattacgaggcagacaaagaagacgctgttaaacgccgtgcgccgccagtagcgcgaagagaacaaggttttgatgtgtttatgggtcgccgttgccacttcatcgcccagtaaaacatgcgggccaaaatagcgatgaacgatagcgtgagcttctgcaaaacgcccctggcgcagtagccagcgtggcgattccggcgtgccccaacgtagcagcgtaatcagcaaggctggtaacgccgctgatgccagcagccagcgccaggcctccgggctttcggaaataaagtgatgtccggcaatacttgccagcacatagcctacggtccacaccacactgaatgcgcccagcaaaataccgcgatggcggcgcggggaaaattcagccagcaaggtgtgaccgactgagtaatcgcctcccagaccaatgccgatcaaaatgcgcaatccaataagatgctctggcgtggtggcaaaaaattgcaagaacgaagcgagcgtaatcagcataaaactgaaggtgaagattttttgccgcccgatatggtcggagatccaccccaaaaccaggctgccaagaaacaaaccaagtaacgccgagccgccgatcattcccgccataaacggcgtcagttgcatggcgggcgtaagctgaataatggcgtaaccaataacgccgaggacataaccgtcggtcaggtgtgcgccgaaagtgagcgcagcaattcgacagtgaaaacggttaagcggtaaatcatccattcgcaccggtgaagtgttcatctttaccccttcattgtccggtaataagaacggcttctcgcctgagaagccgaaaaggcaacgccccgtcatcgcggaacgctgcctgacacattatttttcaatcggatagatagtacccgtgttcataatgccattaggatcgaactgctttttcagcccttccagcaacgcccacgcgctgccgtgttccagtttgctccagtgaacgcgatgtttaccgataccgtggtggtgcaccatcgaaccgccgagacgaatggtttcttcgcagatgattttgttgagcggattgtggtatttgtcgatttcctcttccggcttacagtcaacgacgttgtagtcgtagacgaagtacatgttggtgccgttctgatagctatgagaggagtgaccgcccagcatggtgatgtcgtcggcgtgcgggaactcggtacgaatacggttaataacgctttcgtagatttcgtgaatgcagctccagcagccggacacttcagtggtaaagcccatgttgccggttttgaggatctgcacacgttcggcagctactttatccggtccccagttcaggttgttaaaccaggtttcgatcagcttgctgtccacgcgctggcactgcgggtagcgcgccacgatttcagcaatcccttcacccgtcgccttcgcaatgcgagggttaccttcagccataaagatcagcacacatttgccgtcggcaaaatgggtgaagtgttgggtgccatcttcagcatcatacaaacgagcaatcgacggacgatacccttccaccatgatttcacgcaggatgttgaagccggttttcatgtcttccagcacatagccatagaagagattgttttccggcgtaaatttgaagattttcactgtgacttcagtgatatagcacagtgcaccttcgttgccgatgatgatatgacgaatgtccgggccagccgcgcgacgtggcacgtttttaatgcgtgtgacggtgccatctgccagcaccgcttccagaccaacgaccatatcctcgattgcgccgtagagtgtggaaaactgcccgatactgcgggtcgccaccaggccgcccatctgcgccagcggctttgactgcggagaatgccccgtggtgtaacctttttcacgcaacgcgttttccagcacctccagcggaacgccacattgcgccgtggcctgcatattctcaatatcaatattaatgatttgattcatggcggagccgtcgagcaccaccgagttttccacaacggtttccagcccaccttcggtggcggaagcaccggtacgtggcacaccgttaattttgtgcgcattcataaaattcagcacacgggatacttgttctgtggaaccgagttttacgaccgctgccggaattggcaaagtataaatgccatgaatatccggaaatttacgaaaacggtcaatactgttcttctttaatactgtttcatcggtaattacgcgatctgcaccaacaatttcctttagctggtcgacaatcgctacgcgagataaagacatagtaattccttcctgataataaaaatggaatattcattaataagagaaaacagaaaccaccgttatgaattagcgcactaaataaccgccatcaaccactaataaatgtccgttgacataattcgatgccggacttgcgaggaatacggctgcacccattaaatcctgagtatcaccccaacggtttgccggaatatgatcaagaacacgctggttagtttctggattactacgggtcgccagcgtaatatcggttgcataataaccaggagcaataccattcacctgaatattatattggcctaattcatcgcaataggctttggtgaatccggcaagagcatgtttagtggcagaataagcaggtgaccattgaccacctaagtaagagaacaatgaacagatattaatgattttaccgcttttctgcgggatcataatttttgccgcttcgtagcttaactcgaatgcggcggtcaggttcacgtcaatcatcgggtcccagtcggcacgaccaaagtccagcaccttattcagcttacaaataccggcattgttaaccagaatatctacggtaccgaagcgctcacagcaggcagcgataatcttctgcggcgcgccttctgcggtgatatccacctgcataaaatcaacttcgacaccctgtttttcaatcatttcctttgtttcgccgttatctttgacgaaactaggaataaagacatttgcgccagctttggccaacgccatggcaaatgcctggcctaaaccgctattcccgccggtaacaattgctgttttacctttcagggagaaaaaatccattgagaacgcattgagagattcgattgacatagttagctccaatttccgtaaggcaaaaaaaagaaaggtaacttcccccgcaagagggaagttacctttctcattatctctggtaactggagataatttttagcataaggacataactgctaatgtgatcgtaatcacagtgtgatgttagtattgtcaaataatttaaaaaagcagaagcgtgattactctcacacaacacctctgctttccatgttatttcttattgcaattactagagacctgagaaaagtaatccacctgaaagggcggcttacttttctcttttttttgtctattacaaatgggaatacgatatgcaacacaactcatatcgccgttggataaccctcgcgataattagttttagcggcggcgttagtttcgacctggcttatttacgttatatttatcaaattcccatggcaaaatttatgggattcagcaataccgagataggtttaataatgagtacctttggtattgcggccattattttctatgcccctagcggcgttattgccgataaattttcacatcgcaaaatgattacttccgcgatgatcattaccggattactgggtctgttaatggcaacatatccaccgctgtgggtaatgctctgtattcaggtcgcctttgcgataacgacgattttaatgctgtggtcggtgtcgattaaagccgcatcgttgctgggcgatcatagcgagcaagggaaaattatgggctggatggaagggctgcgcggcgtcggtgtaatgtcgctggcggtgtttaccatgtgggtcttttctcgctttgcaccggatgacagcgccagcctgaaaacggtcattatcatctacagtgtggtttacattctgctgggcattttgtgttggttttttgttagcgataacaacaacctgcgcaataccaataacgaagaaaaacagtcattccagcttagcgacatcctggccgttttgcgcatcagcaccacctggtattgcagcatggtgatttttggtgtcttcaccatctacgccattctgagttactccaccaactatctgaccgaaatgtacggcatgtcactggtggcggcgagctacatggggattgtgatcaacaaaatcttccgcgcgttatgcggcccacttggcggcattatcaccacctacagcaaagtgaaatcccctacccgcgtggtccaaatcctttccatcatcggtttgctggcattgacagccctgctcgtcacgaactctaacccgcaatcggtcgcgatggggattggcttgattttattactgggattcacctgttacgcctcacgcgggctgtattgggcctgccctggcgaagcgagaacaccgtcttacattatgggcaccacggtaggtatttgttcggtgattggatttctgccggatgtcttcgtttacccgattatcggctactggcaagacaccctgcccgctgcagaagcctaccgcaacatgtggctaatgggcatggcggcgcttggcatggtgatcatctttacctttttgctgttccaaaaaattcgtactgctgatagcgcccccgcaatggctagcagcaagtaagccaggaaaattacaggagaaaaatcatgtcgaaaaaatacatcatagggattgatggcggaagtcagagcacaaaagtggtgatgtacgatctggaaggtaatgtggtttgcgaaggcaaaggcttattgcagccgatgcacacgccagatgccgataccgcagaacatcctgacgacgatttatgggcatcactatgttttgccagtcacgatttgatgagccagtttgccggaaataaagaagatattgtcggcattggcctgggctcaatccgttgctgccgtgcgttattgaaagccgatggtacgccagccgcgccgttgattagctggcaggatgcacgcgttacacgcccttacgaacacactaatcctgacgtggcctatgtcacctctttttcgggttatctgacacatcgcttaaccggcgagtttaaagacaatatcgccaactattttggtcagtggccggtggattataagagctgggcatggagtgaaaatgccgcggtaatggaaaagtttaatatcccccgccagatgctttttgacgtgcaaatgccgggcactgttcttgggcatatcacaccacaagctgcgctggcgacacatttcccggctgggctgccggttgtttgtaccaccagtgataaaccggtagaagctctgggagccgggttactggatgatgaaacggcggtaatttctcttggcacctatatcgcgctgatgatgaacggcaaagcactgccgaaagatccggtcgcgtactggccgattatgtcttctattccgcaaacattgctgtatgaaggttacggtatccgcaaaggcatgtggacagtgagctggctgcgcgacatgttaggcgagtcgttaattcaggatgccaaagcacaggatctttcaccggaagatttgctcaacaaaaaagcgtcttgcgtgccacctggttgtaatgggctgatgacggtactggactggctgaccaatccgtgggaaccgtacaaacgcggaattatgatcggctttgattccagtatggattacgcatggatatatcgttcgatactggaaagcgtggcgctgacgctgaagaataattacgacaatatgtgtcatgaaatgaatcactttgcaaagcatgtgatcattactggcggcggttcgaacagcgatctgtttatgcagatttttgccgacgtgttcaaccttccgacacgccgaaacgccattaacggttgtgcaagtctgggggctgcgatcaatacggcggtaggtctggggctatacccggattacacaacggctgtcgataaaatggttcgcgtgaaagatatcttcataccgattgagagcaatgccaaacgctacgacgcgatgaataaaggcattttcaaagacctaaccaaacatactgatgtgatcctgaaaaaatcgtatgaagtgatgcatggggaattggggaatgcggattcgatccagagctggtcgaatgcgtaagtgagataaacagtgccgggtagatgattaatcccggcatattcacgtttccactacaaaataccgggtaaccactgctgaatattgttctctcctgagcagcgtttatgctttaattgctaaaccgatttaatttgtttagcagttagtatattggagcctttatgagcacaagagtatgggtactcggtgatgcggttgttgatttattacccgaaagccaggggagactactacagtgtcctggtggggcgcctgctaatgttgcagtcggtatcgcaaggctggggggggaaagtgcctttattggcaaagttggcgatgatcctttcggtcgctttatgtatcagacactgagtaaagaaaatgttgatacacgttatatgtctcttgatcctcaacatcgcacctcaattgtggctgtaggacttgatgagcaaggagaaagaaactttacctttatggtacgcccaagtgccgatctttttttacaacctgatgaccttcctacatttgggccgggtgaatggctccatctttgttccattgcgctcagtgcagaaccttcccgaagtaccgcatttctggctatggagaaaatacgtcaggctggcggaaacatcagttttgatcccaatatccgcagcgatctctggcagagtgaagcgctattaagaaaataccttgatcgcgcgctttcgctggcgaatatcgctaaattgtccgaagaagagttgctattcatcagtggcgaaagccaggttcagcaaggcgcatattcattagtacaacgttattcgttgactttattgcttatcacacaaggaaaaaatggcgtacttgtgtattttcaggggcagtttatccactatcccgccaaacctgtttctgtcgtcgatacgaccggggcaggagatgcttttgtcgctggattacttgcaggtctggctgattctggaataccaacaaataccagacagcttgaacgaatcattgcacaagctcagatttgtggtgctctggcgaccacggctaaaggcgcgatgaccgccttaccccgacaacacgatctcccttcacaatagtgatcctgctgttgtatctgtaacccgatttgtcgtgcctgtcacatttactaaatcggtttagcgaaaataattgctctggctaaaaagtcagctttattatcaacacctaaaccggtttagcattttagcaatttttataattctctgatgggacgcgacaaattatgtataaaaaaacaactttggcagtgttaattgctttgctgaccggtgctacaacggtacatgcgcaaacggatattagcagtatcgaatctcgactggcggcgttggaacaacgtttaaaaaatgcggaatcccgcgcccaggcggcagaagcaagggccaaaacagctgaattacaggttcagaaactggctgaaacacaacaacaaaatcagctaacaactcaagaagtagcacagagaacagttcagctcgaacagaaatccgcagaaaacagtggttttgagtttcatggctatgcccgttccgggttactgatgaatgatgccgcttccagtagcaaaagtgggccgtatctgactcccgcaggtgaaactggtggagctgttggccgtctgggaaatgaagccgatacctatgtcgagttaaatgtagaacataaacaaacactggataacggtgcgaccacacgctttaaagcaatgttggctgacggacaaagagattacaacgactggactggcggctccagtaacctgaatatccgacaggcttttgccgaactgggcgcattaccaagttttaccggagcattcaaagacagtactgtctgggctggtaaacgctttgatcgcgacaattttgatattcactggttagactccgatgtcgtatttttagcgggaacgggcggcggtatctatgacgtaaaatggaacgatacattccgcagtaacttttctctctacggacgtaatttcggcgatcttgatgatatcgacaataacgttcagaactacatcctcaccatgaatcattatgcaggccccttccagttgatggttagcggattacgggcaaaagataatgatgatcgaaaagatgccaatggtgatctcattcaaactgatgctgcaaatactggcgtacatgcgttagttggtctgcacaatgacactttctatggcctgcgtgaagggacggcaaaaacagcactgctatatggccatggcctgggtgcggaagtcaaagggattggctccgatggcgctctgctgtctgaggcgaatacctggcgcttcgcatcttacggcacaacacctctgggaagcggttggtatgttgcgccagcaattctcgcacaaagcagtaaagatcgttacgtcaaaggcgatagctacgaatgggtgaccttcaatacacgtctgatcaaagaggtaacacagaattttgctctggcctttgagggtagctatcaatatatggatctgaagccaaaggggtatcaaaaccacaacgccgtaaacggcagcttctataaactcacctttgctccaactctaaaagctaacgatatcaataatttctttagccgtccggagcttcgcctgtttgccacctggatggactggagcagcaaacttgatgattttgccagcaatgacgctttcggcagcagtggtttcaatactggcggagagtggaattttggtgtccaaatggaaacctggttttaataccagacagcctcacggatgtgaggcttttactgaaataacaatgaattagagggttatatggatttcgataaaatcgcccaatcgttgcttcctttattaggtggtaaggagaacatcgccagtgcagcacattgcgccactcgcctacggctggtactggttgacgacacacttgccgatcaacatgccattggccagattgatggagtgaaaggttgttttcgtaattcagggcaaatgcaaatcatctttggcaccggcgtggttaataaagtctatgctgcctttattcaggttgcaggtattagcgaatccagtaaagcagataccgctcgactcgccgctcaaaaactcaatccttttcagcgaatagcacggctactttctaatatttttgtccccatcattccagccattgttgcttctggtttattaatggggctcctgggaatggtgaaaacatatggctgggtgaatgccgataatgcgatttatatcctgctggatatgtgcagttcagccgcatttattattctccccatccttattggctttactgctgctcgtgaatttggtggaaatccttatcttggcgcgacattaggagggattctgactcacccggcactcacaaatgcctggggcgttgctgcgggatttcagacaatgaacttcttcggttttgaaatcgccatgattggctatcagggaacggttttccccgtgcttctggcagtatggtttatgagcatagtggaaaaacagttacgcaggtttatccctgatgctctggatctcattctgacgccatttctgactgtcgtcatttctggctttatcgctcttttgattattggtccggcaggacgagcgttaggtgacggtatctctttcgttctcagcacgctgattgcacacgcaggctggttagcagggttgttattcggcgggctatattcagcgattgttattacgggtattcatcatagcttccacgcaattgaagcaggacttttaggtaaccctgcaatcggtgttaatttcctgctgcctatttgggcaatggcaaacgttgcgcaaggcggtgcatgtctggcggtatggtttaaaaccaaagatacaaaaattaaagcaatcaccctaccctcggccttttccgcaatgttagggattactgaagccgctatttttggtatcaaccttcgttttgttaaaccttttattgcggccttaattggtggcgctgccggcggtgcctgggttgtctctgttcacgtttatatgactgccgttggtctgaccgcaatacccggcatggcaatcgttcagccaacatcgttggttaattatattattggaatggtgattgctttcgctgtcgcttttagcctctctttattactcaaatacaaaacggacgaggagtaatgtcgatgccttcacaaatgcccgcgattttacaggcagtgatgaaaggtcagtccaaagcactggcagatgcccactatccttgttggcatctcgctccagtcaccggactaatgaacgatccaaatggcttttgttggtctggaggccgctatcatctgttttatcaatggaatccactggcttgtgatcataagtacaaatgttgggggcactggagttcgacggatttattgcactggcagcatgaaccattagcgctaatgcccgataaagagtacgaccgtaatggttgttactcaggaagcgcggttaataatcagggcgttctcacactttgctataccggtaatgttaagtttgatgatggcagcagaacggcatggcaatgcctggccaccgaaaataaccagggcgggtttgataaactaggccctgtcataccgttacctgatggttacaccggacatgttcgtgatccaaaagtctggaagcacaacagccaatggtacatggtgcttggcgcgcaagataaagagaaacgggggaaagtgctgctgtattcctctgtcgatctctatacctggtcttttcatggagaaattgctggtaacggtctgaatgaaatagataacgcaggatacatgtgggaatgtcctgattttttcgcccttgatggtgaatacattctcctctgttgcccccagggaatggtgcgcgaacatgagcgctatctgaatacttatccctgcgcctggctacatggacagtttgattacgagacaggcaaatttacgcatggcgctttctcagagctggatgcgggatttgaattctatgcaccacagacgatggaagccccggacgggcgacgattgctggtcggctggatgggggttcctgatggcgaagagatgttgcagccaaccagaaagcatcattggcagcatcaaatgacctgttttcgcgaactctcattccagcagggaaaattgtttcagatgccaatcagggaactcgcgcaactgcgtgaagctgaacacttctggcaaggaaaagcggatcatgcgccgcatgtcgaaattgaacgcctggaaatggacatcattccgtcgggtgagctgtatctgaattttggcaatgcgctggcactgcatcttaatgacgatggtattcaactacagaggagaagccttgcagggcaagagaaattaactcgttactggcgaggaagcgtaacgtcactgaagattctctgtgacagttccagcgtagagatattcatcaataatggtgaaggtgtaatgagtaatcgttattttccccatcatccagcttcgctgatattacagggtgagtctgacgtcacgttacgctactggtcgctacgcgcctgcatggtagaatgagggttttgaattacggatcctcgtcgtgagaaaaaccaaacgcgttactattaaagacattgctgaactggcgggagtgtcgaaagcaaccgccagtctggttctcaatggtcgtggcaaagagttacgtgttgcgcaggaaacgcgtgagcgtgtgctgagtattgcccaacagcagcattatcagcccagcattcatgcccgctcattacgggacaaccgcagtcataccattggtctcgtcgttcctgaaatcactaactacggatttgcagtattttcccatgaactggaaacattgtgtcgggaagcgggcgtccagctcctcatatcctgtactgatgaaaatccttcacaggaaacaatggtggtgaacaatatgattgcccgccaggttgatgggttaatcgtcgcatccagtatgctgcatgataatgactatcaaaaacttagcgagcaattacctgttgtgttgttcgatcgccacatgaacggcagtacattgccattggtcattactgactctgtttctcccaccgccgctctggtggcagatattgcaaggagtcacccggatgaattctattttctgggcggacaaccccgtttgtcaccgactcgcgatcgactggaaggatttacacaaggcttgcagcaagccggagtaacgctacaacctgaatggattattcacggtaattatcatccgagctcaggctatgaaatgtttgccgcgctatgcgctcgtttaggacgtccccctaaagccttattcactgccgcttgtggattactggaaggcgttctgcgctatatgagccaatataatttactcgacagtaaaatacacctggcgagttttgatgatcattacttgtatgattcactttcggtaagaatcgacacaatacaacaggataatcgccaacttgcttttcactgctttgaacttatttcgcaactgattgaaggtgaaacgccatccccattacagcgttatcttcctgccagtctacaaaaacgctaccgataatcccgtcactatcttgcatcgcccctgtaaaacggggcgattattttcatcctgaacgttaaatattaatgatgaataatcaaatcaggcaatattcaaatatttatgtgtctgcatcgacaaacgccagttgcgcgcaatgcaggtatcgatacataaacgcgtagcatcttccttctggctaattggctgaagtgcaatgactcgcggtttatcatcggtcagcgtcgccagcaattcatccagtgcttcaatatcacgtacgcgtcctactgggtgtttgatttcgttggctcgctccagggcttgtgacaacacttcatagccaccgcgcatatttagctttggtgatacggtaacccaggtattcggtgtgcagcgtacttcatgagtaccactggtttcgatctggcagctaaaaccgttcttttcgagcaggtcagtcagtggcagcaaatcatgaatgcaaggctcaccacccgtaatcaccacatgacgcgcggtgtatccctgacggccaatgacagccagcaaatcttcactgctcgccgccccccacttatcactctctttggtcttcgccagaatgctgaaaagggagacttcccgatcctcaagcttttcccaggtgtgtttggtgtcgcaccaggcacagccaaccggacatccctgtaaacgaataaaaatggcggggacgccggtaaagtaaccctcaccttgcagggtctggaacatctcgttaatcgggtactgcatagcattctctgtgaagtggataattgttaattattgcagatcctgccacaacaatcatgtcttattaacattctgttacaggcaggtttgatgcaaaaattggctcagatcattaagaataaaatgaagcggcgtattatgttttaaggaattaattaaaaggaatttaaccatgctcagaatattcatcgcaattatatttattttcaatttatcaggctgtggatataacgatattcaaacctatgatgagcaggttaacgcctcctggtctgaggtattgaatcaatatcaacgtcgcgccgatcttattcctaatcttgtcgccagcattaaaggttattccagccatgaacgagatgtactggaagccgtaacattggctcgtagccaggctaatcgcgccagtagcgatcttcagcaaactccgggagatgaacaaaaattacaaacctggcaacaagctcaggcgcaggtgtctcgcactctcggtcagttaacgataattagtgaacgttaccctgagctaaaggcccaggaactctatcaaaatttgatggtacagctcgaaggaagtgaaaatcgaattgccgttgcgcgaggaagatatattaaagctattgaacaatataatgtcactatccgcaaattccccgcagtgttaaccgcaaaggtcatggattacacaccaaagaaaaattatttgccggatgatgtcgccgctgtgagtaaagccccgacaatagattttagccagaatactaatgctcattaagcggggaagtcctgtgcgaatttttatcttccttatggctttcttctgttcatctgtgtttgccacacaaattccagtgcctgaatcacccaggtatgtgaatgacttaaccggtaaattgacgaacgatgaagtaaatactttgaccaatcagattaaagagctgacgcaaaaaagccacgcacaactggtcgtgttagtggttgaaacaacgggcgatgaaaccatcgagcagtacgctacgcgggtattcgatagctggaaaccaggtgataaagaccgcgatgatggcgttctactgttagtcgcctggcaggatcataccgtgcgtattgaaatcggttacggactggaaggcgttattacggatgcgcagtctgggaaaattattcgcaacagtattattccggcatttaaaaatggcgacctggctggcggcttgcaaaagggaataagcgatattgataatcgtctgacggggaataatttagcaacgataacaccgaccgatcaccctttgccctttaacggttggtgggctttgttagtctgggcaatagtactgacctttatttccgccagaggatatttcaaaacgctgggactaatttgcttcacagctattgtactggcctttgttttacctatagcaggtttcagcggaagctggggagtactcgcaacattactctgcttcgctacaccgttcctggctgtcgctatcgcttttacccccttcggcaaaaaggttcgggattcgatgcgtagtgccaaccgaccgtcacgttacgaaagaagtaactcggcctcctggcgttcttcatcatcgtcgtcatcttcctcttcatcctcttttgacaatgataatttcagcggcggcggcggttcatctggcggcggtggcgcctccgggcgctggtaacaaaaggaattgaaatgcgtatttttctcttacttctgatgctatatggtttccaggcattagctgaacaattgccttcagtaactgacttaaccgggacattaacgacagaagaacaaactgctttaaatcaacaattacagactctcgagcagcaaaaccacttccaggtggccgtgttggttacgccgaccacagggggcaaaaacattaaacttgcagcctctcagagctacgggttatatcactggaaacccgttggagagaagcggtacggcgaaggtatcttaattctcgtcgtttggccggaagggctggcgtcaatgaagattgggcatggactgaaagagatgctgccaccggaacaagctgcgcaaattgttcattaccatatgcaaccggaattcaaaaaaaataatctcttctccgggttaacgcagggaattgaaggcatcgcacagtttacctatataaaagcgaatcttagccctttggatgctttagccaatcatctgtttgctaatccgcaacgctcgctgccatgtcttgcctggacattactgatgatcgttgccatcgttgtcctctggcgatttaccagccgtcccgggcctggcatatggatgatatcgatgattactcctatggtctggtttttcttctttcaggatgatgtcatcattcggcgggtatcgctcgtttgttttagtttatttttcgcagcaacctgctggcagcgtatcgcggtaatttttcatatgtatcgcgtatttcctatgatgctggccccaaaaaataaaaacgctaaagtgaaaaaaaaaaagacgactcagcaggtttctcaatccgaacgaaactcattgtttgtcgtgctgctgataattgttgtgggatggtgcctggtattcgccagtaataaagatatagcattcatctcaacaattattgggctaattgatcattttatcggcccaataaccattgctggcatcgttctgctgatcattgtggccaaatttactggcaatcttaaactgggatcaggacataaaagcaacaggaaaacggggaatcgtaatgctcattctcgctcttcgtcgaaaaattctttccgcggtggcggcggttcttcaggaggcggcggttcatccgaccgttggtgatcgttatgcgtataatcctttttctactcactttatggtgccttcctgtgcttgcccagcaaattgctgtgccggagctgcgccaacaggtgaccgatattactggtaccttaagcacgtctgaacaacaatcactaacacaacagctgcaggatattacacaaaaaacacgggcacaggtcgctgtattaatagtgccatccaccggagacgattctattgaacaatatgctacaagagtttttgacaattggcgtttaggagatgccaaacgcaatgatgggatactgatcattgttgcctggtcggatcgcactgtccgcatccaggtaggttatgggctggaagaaaaggtaaccgacgctctggctggagatatcatccgtagcaacatgatacccgcatttaaacaacaaaaattagctaagggattagagttagctataatcgctttgaataaccgactcacttcacaacaccaatattcggttaatccttcagaaagtgaatcagcatcttccagcgatcattactactttgctattttttgggtatttgcagtgatgttcttccctttctggttttttcatcaaggcagtaatttttgtcgcgcatgtaaaagcagtgtctgtatttcagcaatctatcttttagatttattcctgttctccgataaaactttttccattgctgtatttttcttcttttttactttcaccaccattatggtctttacctgtttatgtgtacttcagaaaaaagcatctggtagaagttatcattcagacaacagcggttccggtggtggctcaagtggcggcggatttagcggcgggggcggttcttctggcggtggcggcgcgtccggtcgctggtaactcaaccataaaaaatgccagcccgaaggctggcatttttaaatcagataaagtcagacttatgcctggcctttgatctctttacgaccgttgtacggtgctttttcgcccagagcttcttcgatacgaatcagctggttgtatttagcaacacggtcagaacggctcatagaaccagttttgatctggcctgcagcagtaccaacagccaggtcagcgatggtagcgtcttcagtttcgccagaacggtgagagataactgcagtgtagccagcgtctttcgccatcttgattgcagccagagtttcagtcagagaaccgatctggttgaatttgatcaggatggagttagcgatacctttttcgataccttctttcaggatcttggtgttggttacgaacaggtcgtcaccaaccagctggattttgtcgcccagaactttggtctggtatgcgaaaccgtcccagtcagattcgtccagaccgtcttcgatggaaacgatcggatactgtttggtcagttcttccaggaagtgagtgaattcttcagaggtgaacgctttgttgccttcgccagccagaacgtatttaccgtctttgtagaattcagaagctgcgcagtccatcgccagagtgatgtctttgcccagttcataaccagcagctttaacagcttcagcgataacagccagagcttcagcgttggaacccaggttcggcgcatagccaccttcgtcaccaacagcagtgttcatgcctttcgctttcagaacttttgccaggtgatggaaaacttcagaacccatgcggatggcttctttcacagttttcgcgccaaccggctgaatcatgaattcctggatatcaacgttgttgtcagcgtgctcaccaccgttgatgatgttcatcatcggaaccggcatagagtatttgcccggagtgccgttcagttcagcgatgtgctcgtacagcggcatacctttagcagctgcagcagctttggcgttagccagagatacagccaggattgcgttcgcgccgaatttggatttgttttcggtgccgtccaggtcgatcatgatcttgtcaatgccagcctgatctttagcatctttgccaatcagcgcctgagcgatcgggccgtttaccgcagcaacagctttggttacgcctttacccaggaaacgggatttgtcgccatcgcgcagttccagagcttcacgggaaccagtagaagcacctgacggagcagctgccataccgacgaaaccaccctccagatgtacttcggcttcaacagtcgggttaccacgggagtcgatgatttcacgaccgatgatttttacgattttggacattaggttttcctcaagtcactagttaaactgaaactccagacaaacaacgcgtacccagggtacgcgttgccgttctaacttttttacttacttcgcctgacgtttctggaactcgctggcggctttcacaaagcctgcaaacagcgggtgaccatcacgtggagtagaagtaaactccggatggaactggcaagccacgaaccacggatgattcggaacttcgatgatctcgaccaactgatcatccccggaacggcccgcaacgcgcagacctgcatcttcaatctgtttcaacagcatgttgttgacttcgtaacggtgacgatgacgctcaacaattgtcggcgcattgtacagctggcgaaccaggctatcgtcaaccaactggcactgctgtgcgccgagacgcatggtaccgccgagatcgctcttctcgctacgaacttcaacgttgccgttttcatcgcgccactcggtaatcagcgccacaaccgggtacttacagtctggcacaaattccgtagagttggcgttctccatgttggcaacatggcgagcgtaatcaattaacgccacctgcatacccaggcaaatgcccagataaggaatattgttctcacgcgcaaaacgcgcggtcgtaatcatgccttctacgccacgatagccgaaaccgccaggtacgaggattgcgtccagacctttgaggatttcaacgccgcgcgtttcaacatcttgtgaatcgatcagtttgatgttgacgctgacacgattcttcagcccaccgtgtttcagtgcttcgatcacggatttgtatgcatccggcagctcaatgtatttgccgaccataccaatggtgacttcacttaccggattcgcttcttcgaagataacctgttcccattcggacagattcgcttccgggcagtttaagctgaatcgtttacaaatataatcgtccagcccctgagatttcaacaggcccggaattttatagatggaatcgacgtctttcagagaaataaccgctttttccggaacattacagaacaatgcaatcttcgcacgttcgttcgccggaacggcgcgatctgaacgacaaatcaggatatcaggctggataccgattgaaagcagctcttttacagagtgctgagtcggtttggttttgacttcaccagacgctgccatgtacggcaccagcgtcaggtgcataaacagggtgtgctcacggccaatttcaacagccatctggcgaatcgcttcgaggaacggcagggattcgatatcacctacagtaccgccgatttcgaccagtactacgtcatgaccttcgccgccttccagcacgcgctctttgatagcgttagtgatgtgcggaataacctgtacggttgcgccgagatagtcaccgcggcgttctttacgcagaacgtcagagtagatacgccccgtggtgaagttgttgcggcggctcattttggtacgaatgaaacgctcgtagtgccccaggtccaggtcggtttcagcgccgtcttcagtaacgaacacttccccgtgttggattgggctcatagtaccgggatcgacgttgatgtacggatccagtttcatgatggtcacattgaggccacgggcttcaagaatggctgcgagggaggctgcggcaatgcctttacccagagaggatacgaccccgccggtcacaaaaatatagttcgttgtcatgctgaacctgagaagttaggttgaaaagacgatggaataaccaggacgggaaagcagtatacccgaacatgacctgtgccacaaactttcattatccctcctcttcgccagcgcactattgaaatcaggagtgagaaaatagcccctttggggtaaatgtttttgacgcaaatcaagcgcttgtcatttaaaaaatgacacaaatcgcgcttgaccgcgtaattcccttagagatcaatttcctgccgttttacctgttgccagacttcttccattgtttcgaggtcaacacctgtcatttccagtccacgcgcggcaacaatacgctccacttcgcgaaaacgacgctcgaatttttcgttcgctttttgcaatgcgatttccgcttttgtccctaaatgacgagccagattgaccgtggcaaacagcaggtcacccatttcctcctccagtttagcctggtcgacaacagcctgccgcgcctcgtacatcacctcgtcgatctcttcgtagactttatcgactaccggaccaagcgtcgtccagtcgaaaccaacgttggcgcaacgtttctgaattttttgcgcacgcattaaagccggtaaactacgaggaatatcgtccagcgccgaatgctgcgctttctgcgcgcgctcttcggttttgatttgctcccaacgggcaagcacttcactactattttcggcagaactgtcagcaaaaacatgcggatggcgacgctctaatttatcgctaatagcagcgcaaatatcattaaagtcaaagcgcccttcttcctgagccatttgtgcgtaaaacaccacctggaacagcagatcgcccagttcaccgcgcagatcgtcaaaatcttcacgggcgatggcgtccagcacctcgtaggtttcttcaagggtgtaaggcgcaatggtggcaaatgtctgctctttatcccacgggcagccgttttccgggtcgcgcaggcgctgcatgatggtgagcaaacggtcgatttgattcattgaattatcctgaaaattgcgggtccgtcaggtggaaacctgtgaccagaatagaagtgagttagtaacacctacccaatcagcacgttaattttggctttaatgagttgtaattcctctggggcaactgttcctttcttcgttgctcctcttgcccgccaggcgattctttttacctgatcagctaacgctacgccatcacgttcctgaccggatagaacaacttcgaacggatatccttttgattgcgttgtacaaggaacacacagacacatacctgttttgttgttgtacatgaacggactcaggacaacagccggacgatgtccggcttgctcgctaccttttgtcgggtcaaaatcaacccaaatcagatcgcccgtatcgggtacgtatcggcttaccattaccagacttccttatctttcggctccccccagtcgatattctcgtggaggttttccggcgtgatgtcgttgaccagttcagcaagcgtaaatacgggctctttacgcactggctcaataattaatttgccatccaccaggtcaatcttcacttcatcatcaatattcagattgagcgcctgcattaacgtagccgggatccgcaccgccggtgaatttccccaacgctttacgctactgtggatcataaccctttcctcaaaccgcgatcatatgtagatacagtatatatcaatctacattgtagatacgaacaagtttcggcctaactcccgtgcaaccgacgcgcgtcgataacatccggtacctggttgagtttacccagcacgcgacccagcacttgcaggttgtaaatctcaatggtcatgtcgatggtcgccagttgctgtttggtgtcgctacggctggcaacgccaagtacgttcaccttctcgttggcgagaatggtcgtgatatcacgtaacaacccactacgatcattagccaccacgcggaccaccagcgaatatccggcggagtagctctcgccccataccgcgtcaacaatgcgttctggcgcatgggagcgcagttccgccaattgttcgcaatcggcgcggtgtactgaaataccgcgcccttgggtaatgaagccgacaatctcatctccaggaatcggctggcagcagcgcgcgatgtggtgcatcaggttaccgaccccttctaccaccacacgaccgttatctttactgcggttttgcggcgtgtagcttttttgctgaagctgtttcagcgcggcggcgtcctgctcttcggcactcggcttattaaattgcgattgcaggaagttcaccatctgattgagacggatatccccgccaccaatcgccgccagcaactcgtcgacatcattgaagttgtaacgcggcagcagatgtttttctgcttctttcaggctgatccccagatgttccagctcgtcgtcaaggatttgccgcccagccagaatgtttttgtcacggtcctgtttacggaaccaggcgtgaattttcgaacgcccacggctggttgtgacgtaaccgaggtttgggtttaaccagtcacggctggggttcggctgtttctgggtgataatttcaatctggtcgcccatctgcagctggtaggtgaacggcacaatgcgcccgccaatttttgccccgatgcagcggtgtccgacatcactgtggatgtggtaagcgaagtccagcggcgttgatcccgcaggcaaatcaacgacatcacctttcggcgtaaagacgtacactcggtcgtcaaagacctgactacgtacttcgtcgagcatttcgccggaatcagccatctcttcctgccacgcaatcagtttacgcagccaggcaatccggtcttcatgtcccgaacgtgcgccgccagcagccgcgccctctttatatttccagtgcgcagcaacacccaactctgcatcttcatgcatctgtttggtgcggatttggatctcaacggttttgccacccggccccagaaccacggtatgaatggactgataaccgtttggtttcgggttagcgacgtaatcgtcaaactcatccggcaggtggcgatagtgagtgtgcactatccccagtgcggcataacaatcctgtaaacgctcggcgacaatacgtaccgcacgcacatcaaacagctcatcgaaggcgaggttctttttctgcattttgcgccagatactgtagatgtgtttcggacggccatacacttcagctttaacgccttcagctttcatctcagcgcgcagatggccgacaaactcttcgatatagtgttcgcggtcgagacggcgttcatgcagcagttttgcgatgcgtttgtattcggtcgggtggagataacggaagcagtaatcttccagctcccatttcagttgcccaatcccaagacggttcgccaacggcgcgtagatattggtgcactcttttgccgccagtacacgttcatcttccggcgcatcttttacttcgcgcagatgagcaatacgctccgccagtttgatgactacgcagcgaaaatcatcgaccatcgccaataacatccggcgaacgttatcgacctgttcggaggaaacagaatcagtgtgcgtcgctttcagctggcggatcgccgccatatcacgcacgccgtgaataaggttaacgaccgacttaccgacgctatcacgcagcacatcttcgctgactacgttggcatcggccagagggaacagcagcgccgcccgcagcgtgtcaatgtccatacttaatgtcgagaggatctccaccatctcaacaccacgccacaataacagactggcatccggatgcccctgcgtctgttgcagacaatacgcccaggtttcggctaagcactcacacgacttctggctggtaatacccagacttgcgatccatttttccggatcaaattcaccagccttattgatatgtgcacttcttaccgcaaccatcgtcctctcctttagggaccagacctgccgaaatcggcaaatcgtaactatttaacgcgcgagaaaagtaccatcgattccagatgtcccgtgtgtgggaacatatccagcatcgccagtcgcgcaatggtatatcctgcttttaataacgcttcgctatcccgagccagcgttgcagggttacaggatacataaactatacgaataggttccagttttataatttgctgcataacacctgcggcacctgctcgcgccgggtccaacaacactttatcgaagccgtttttcgcccacggctgctttgtgacatcttcttcaagattttcgtgataaaacgtcacattctgtaagccattaagacgcgcattctgctggcctttttccaccagcgccggaacaccttctacacccaccacactggcagcttgtgtcgccaatggcagtgtaaagttgcccataccgcagaacagatccagtacgcgatcttcaggttccacatccagccattccaacgcacgcgctaccattttctggttcacacccgcattgacctgaataaaatcgcgcgggctaaaagttaagcgcaacccatttgagtcataccagggcatctcaccagagacggtttcgagtatctcactatcgggggcgagatacagatccaggccttcagaatgcgaaaagcattccagtttttcgcgatctgccgaacttagcggtgcggtatggcgcaaaatcattagcgtgccgctggttgcctgtaccagttcaacatgaccaagatggcgcatagcttgtaagctgcccaggcatgccctgactttgggcagcaatgcttcaagttggggcactaaaatggggcattgtttcacgtcgacaatgtcactggagcccgctttgcgaaaccccatctgaagttgctgtgttttcggtaagtagttcagacttaaacgcgcgcgacggcgatagccccagggaacatcggcgatcacttcagagacttcgtgtttcattaatcgggcgagtgccgcacttttgcttcgctgctgtaaatccacactggcgtgttgttgctgacagccgccgcatacgccaaaatgaggacagcgtggcgtttcgcgttccgggctatcgcttaaccgacgtacgactttagcgcgggcatactgttttttatcttcagtaacagtaacttccgcgttttcctgcggcaataatccggggataaataatgttttgccgttatgtcgcgccacaccctgaccaaaagagtcgaggtcgttgactgaaacggttatgatctgacgcgtcgtcgtgcgtcgttttgcagagtagaattgcgccattggcgagactttctcaatttaacagtgtgaccttaattgtcccataacggaactccatgaccaactacagcctgcgcgcacgcatgatgattctgatcctggcaccgaccgtccttattggtttattgctgagtatctttttcgtcgtgcatcgctataacgacttgcagcgtcaactggaagatgccggtgccagtattattgagccgcttgcagtttctactgaatatggcatgagcctgcaaaatcgcgaatctatcggtcagttaataagcgtactgcatcgtcgccattccgatattgttcgcgcgatttcggtttatgatgaaaataaccgactctttgtcacctccaattttcatcttgatccctcatcaatgcagctcggcagcaacgtgccgtttcctcgccagctcactgtcactcgtgacggcgatattatgatcctccgcacgccgattatttctgaaagttactcccccgacgaatcgcccagtagcgatgccaaaaatagtcaaaatatgctgggatatattgcgctggagctggatcttaaatcggttcgcttgcagcaatataaagagatctttatttccagcgtgatgatgctgttttgtatcggtattgcgcttatttttggctggcgcttaatgcgcgatgtaaccggtccgattcgcaacatggtgaataccgtcgaccgcatccgtcgcgggcaactcgacagccgggtggaaggatttatgctcggcgagctggatatgctgaaaaacggtatcaactcgatggcaatgtcgctggcggcttatcacgaagagatgcaacacaatatcgaccaggcgacgtccgatctgcgtgagacgctggagcaaatggagattcagaacgttgagttggatctggcgaaaaagcgcgcccaggaagcggcgcgtattaaatccgagtttctggcaaatatgtcacacgagctgcgtacaccactgaatggtgttattggctttacccgcctgacgctgaaaacagaattaacaccaacgcagcgcgatcacctgaatacgattgaacgttcggcaaataatttgctggcaattattaatgatgttctcgacttctcgaaactggaagccggtaagctgattctggaaagtattccattcccactacgcagcacgctggatgaagtcgttaccctgctggcacattcttctcacgataaagggctggaactgacgctcaatattaaaagcgacgtgcctgataacgtgatcggcgacccactacgattacagcaaatcatcactaacctggtagggaatgcaattaaattcaccgagaatggcaacattgatattctggtagaaaaacgtgcgctgagtaataccaaagtgcaaattgaagtgcagattcgggataccggcattggtattcctgaacgcgatcaatcgcgcttattccaggccttcagacaggctgatgccagtatttcccgccgtcatggtggcaccgggctggggctggtgattacacaaaaactggttaatgaaatgggcggcgatatttcgttccatagccagccgaatcgcggttcaactttctggttccacattaatctcgatctgaacccgaacattattatcgaagggccatccacccagtgcctcgctggtaagcgcctggcctatgtcgaaccaaactccgcagcagcacaatgcacgctggatattttaagtgaaacgccgctggaagtggtttatagcccaacgttctccgcgctgcctcccgcgcattacgacatgatgttattaggcatagcggtgaccttccgcgagccgctaacaatgcaacatgagcgattagcgaaagcagtatcgatgaccgatttcctgatgctggcacttccttgccatgcacaagtcaatgctgaaaaacttaagcaagatggtatcggcgcgtgtctgctgaaaccattaacacctacgcgcctgttgcctgccctgacggaattttgtcatcacaaacaaaacacgcttttgcctgtaaccgatgaaagtaagctggcaatgacagtcatggcggttgatgacaaccccgctaacctgaaacttatcggcgcattgctggaagatatggtgcaacatgtggaactttgcgatagcgggcatcaggcggttgaacgggcgaaacagatgccgttcgatttaatcttaatggatattcaaatgccggacatggacggcattcgggcatgtgagctcatccaccagctcccgcatcagcagcaaacgccggttatcgcggtaacggcgcatgcgatggccgggcaaaaagagaaactgcttggcgcggggatgagtgattatctggccaaaccgatcgaagaagagcgattgcataatttgctgttgcgctacaagcctggcagcggtatttcctctcgcgtcgtgacgcccgaagtcaacgaaattgtggtcaacccgaatgcgaccctcgactggcaactggcactacgccaggcagcaggaaaaaccgatttagcgcgcgatatgctgcaaatgttactcgatttcctgcctgaagttcgcaacaaagttgaggaacagctggttggagaaaacccggaaggcctggttgatttgattcataaactgcatggcagttgcggctatagcggtgtaccgcgtatgaagaatctctgccaactgatcgaacaacagctacgtaacggtactaaagaagaagatttagagccggagctgctggaactgttggacgagatggataatgtagcgcgcgaagccagcaaaattctcgggtaatggacgtcttgtcgagtagcaaccggatttttatgacgctggtttcagattggtgacaagtgcctgtgtttatgccggatgcggcgttaacgccttatccggcctgcaaaaccaattaaattcaatgaattaaaaaatgatgtagccctgatacgtagcgcaacaggcaattttgcgtttggcatcagtctcaaaccggctccagatagagccggttttggttttctgtcttaacgcaccatgcacggacgcttgttatcgaacgtccagccggggatcaggtactgcattcccatcgcatcgtcacgcgcgccaagcccgtgtttctgatacagctcgtgcgctttcatcacttgatccatatcgatttctacacccagccccggtttttctggcacctgaaccagaccgcctttgatctctaacggttctttggtcaggcgctgattaccttcctgccagatccagtgcgtatcaatcgcggtgattttacccggtgcggcagcggcaacatgggtaaacatcgccagggaaatatcgaagtggttgttggagtgtgaaccccaggtcaggccaaattcatgacacatttgcgccacacgtaccgaaccttgcatcgtccagaaatgcggatccgcaagcgggatatcaacggattgcaacgagagcgtatggcccatctgccgccagtcggtggcgatcatattggttgcggtcggcaggccagttgcgcgacggaactctgccatcacttcacgcccggagaaaccttgctccgcaccacacggatcttctgcataagccagcgaacctttcaggtatgtaccgattttaatcgcttcgttcagcgaccaggcaccgttaggatcgagcgtaatacgcgcctgcgggaaacgttgcgccagtgccacaatagattcggcttcttcttccccggccagtacaccgcctttcagtttgaaatcgttgaagccatatttttcatacgccgcttccgccaggcgcaccaccgcatccggcgtcatcgcttcttcatgacgcaggcgataccagtcgcatgagtcatccggctggctttgatacggcagcggtgtagctttgcgattaccgacgaagaacagataaccgagcatttcgacttcgctacgctgttgaccatcgcccagcagcgatgccacgtttacccccagatgctgccccagcagatccagcattgccgcttctatcccggtaactacatgaatagtggtacgcaaatcaaatgtctgcaaaccgcgcccaccggcatcacgatcggcaaaagtattacgcaccagcgtcagaacgtttttgtattcacccagcgttttacccaccaccagcggaatcgcatcttccagcgttttacggattttctcgccgccgggaatttcccctacgccagtgtgaccggaattatctttgataatcacaatattacgcgtgaagaacggtgcatgtgcaccactcagattcatcagcatactgtcatgacccgccaccgggatgacctgcatttcagtaacaacaggcgtcgtaaattgagaactcatatttatgtcctttttcagaatcaatgacggccgaaaacgggacgtttacggtcaaaggtccagccggggatcaggtactgcatcgggcctgcgtcgttacgcgcaccgccaggcagacgtttataggcctcatgtgccttttgtacctgttcccagtccagttccacgcccagaccgggcgcatcaggaacggcaatttttccgtttttaatctccagcggatttttggtcagacgacaatcgccctcctgccaaatccagtgggtatcgatagcggtaggattacccggtgccgccgcgcccacatgggtaaacatcgccagagagatatcaaagtggttattagaatggcagccccaggtcagcccccagtcgtcgcaaagttgcgccacgcggactgcaccggaaagcgtccagaagtgcggatcggcaagtggaatatctaccgcattgagcatcaccgcatgacccatttcgcgccagttggtggcgatcatgttggtcgcgacgggcaagccggtcgcccgtcgaaactccgccatcacttcacgaccggagaaaccctgctcagcgccgcacgggtcttccgcataggtaaggacatcattcagccctttgcacagagaaatggcttcatcaagcagccaggcaccattgggatcaacggtaatccgcgcatcagggaagcgtttcttcaatgcacgaacagtgtcgatttcttgctcgccaggtaacacgccacccttaagtttgaaatctttaaagccatagcgatcctgtgaggcttccgccagacgcacaacggcttcgctgttcatcgctttctgatgccgcaactgataccactcatggttgcccggcgtattttccagataaggaagatcggttttggtccgatcaccgatataaaacagataaccgagaacggtaatagcatcacgttgcttgcctggccctaacagttcgcagaccggaacattcagcgcctgacctaacaggtcaagcaaggcggcttccagcgccgccacggcattaacgcgcaattcaaaagtccaggcacctttgccgaaggtatcaaaatcggctgcctgattacctttatgcgcctgctgaaccactttattcaggcgcgcaacttcctggcccagcaccatcggaatagccttgaccagtgtttgataaatcacctctccgcccggcgcttcaccaatgccggtatgcccggcattatcggtgagtaccacaatattgcgggtgaaatatgcgttatgtgcaccaccaatattaagcaacatgctgtcatgtccggcgaccggaatgactttcatatcagtaataacaggactggattgtgtcgtcatcttattgccccgcgacaggtttcagctcaatacgcttgatatcgcccaccagcaccaggtagctgagtaccgcgattaaggcatgaacaccaacataaatcagcgccccattaaaggagccagtcgtgccaacgatataaccaattgcgattggcgtgacgatgccagaaatgttaccaaacatgttaaacaggccaccggaaagaccgctgatctcttttggcgcagtatcagccattacagcccaacccagcgcaccgatccccttaccgaagaaggccagcgccataaagccgatgatcatccactcaacgttgacgtagttgcagaacaccatcaccatcgacagcaacatgcccatcacgatcggtgttttacgcgcaatgttcagtgaacccgtgcgacgcatcagccagtcggaaataatcccacccagcacaccgccgataaaaccgcaaaccgccggaacggaagccacaaagcccgctttcagaatcgacatcccgcgcgcctgcaccagataaaccgggaaccaggtaataaaaaagtaagtcagggcgttgatacagtactgaccgatataaacgccgatcatcatccgtgacccgagcagctgtttgatctgcccccacttcacgctgaacggcactttaactttggtgttttgctgatccatattgatcagcgcgccacccgcggcgatgtactccagctctttctgatttacgcccggatgttgatttggctcgtggatgactttcaaccagataaagctgatgacaatgcccagaccgcccataaagaagaagacgtgtgaccagcccacttcatgagtcaaccagcccataatcggcgcgaagataaccgttgcgaagtattgggcggagttaaaaatcgacaccgccgttcccctttcctgcgccggaaaccaggccgcaacaatgcggctgttgccagggaaagagggcgcttcagcaagcccgaccaggaagcgcagtgtaaacagggcaacgataatgccgaatccactaaagatatcgacgaagccttgcagcaaggtaaacatcgaccagataaagatcgaccagaagtagacgcgttttgaaccaaaacgatccagcaaccagccaccagggatctgcccgataacatacgcccatgagaaggcagagaacacatagcccattcccacgggatcaaggccgatatctttggccatttccgaaccggcaatagaaagcgtagcgcggtcgccgtagttgaaggatgtgacgataaacaacatcaccactatccagtaacgagcattcgtgcgtttttccacactgctcgcagcctgacttaaagaactcattgttgcactcctgaaaattcgcgttagccacgctcactctggactgcgacatcgccaggaaatcagaggtgacgtagggtgtttttgccgtttttataggtcgttcgccgaatacggcgcgtgtttatatctggcaatagcagtataaaaagcgcgccatagcggctcaccgtgcaacaacacaacattaatgcgttcaatgaggcccgattttggcattagccctggacggtggaatccacttcacggaaatgaaaacaagaacaagaaaggaagggttaaaacgaagaaataaagaagagtatgaaatggatcgcttgactccaggcaaacgccagtaaaaatccgcgctatgaagcagtttttactggcatttgcctgaaaagattcgattcagcaccgctaaaacggcatttaccgctcgctgaacatatcaggacaacatcgtgccccaatgttcaacccacggatttgattccgtttccggttccgggttctcactggcgtcaatcaacagcatttcgccaacccgctgagcgctctgttcctgcaacaaggcatcgaactgtttgccgccattgcagaaattcacataactactgtcgccgagcgcaatcacgccataacgcagattcggctggaagcccagactatctttgattccctgaaagagtggcacaatactatcaggaaggtcgccctgcccggtcgtggacgtaaccaccagaacatacttatcctgatagggcagccagtcgcttaattcaggatcttcaaataccgttgctttgtggccctgcgcggtcagaatcgcttccgcttcttcggccactaacagtgaattcccgtacatggtgccgacaaaaataccaatttccgccataccgttttctccctggattaggaacttatctctccatcctgacccgatggcgcactgaactcaaccctttcattttcaggaagcagaccgcgccagccaaattgtgataatgcctgcatccaggtgtcgtccaggcccgcgtgaatagccagcggctcgccagtaaaaggatgcgtcaatgacaactgactggcatgcagcattaaccgctgaaggccaaaatgctcagcaccgctgcgattctggcgtaaatcaccatgtttgctgtcgccaataatcgggtgccgcaaatgggcaagatggcgacgaagctggtgcttgcgtccagttttcggctccagttccaccaggccgtagcgcgtggtcgggtaacgtccagtcgctaccggcatttctacggtcgccagaccgcgataatgcgtcactgctggctgcgggcctttatcttcgcgggcaaatttatcagcgattttgtccagttcttccaccagtggataatccagcaccgcttcttccatcaaccagccacgcacaatcgcatggtaacgtttctggatttggtgctgttcaaactgttgtgccagcagccgtccggcttcgctggataatcccatcaacaacacaccagaagttggtcggtccagacgatgagcagtaaaaacatgctggcctatctggtcacgcacggtttgcatgaccactactttctcgtcgcgatccagccagctgcggtgaaccagccagccggagggtttatttaccgcaaccagccattcatcctgatagagtatttccagcattagctcgcatcatccgcaaaaagagcatccagtttttccagctctgccagaataagcgcgcgttgcgggtagtccgtcgccagcgccatttcataataaggcgcaacagcaaaagcgcccggtaacggctggttgttatctaacaaatcgtgcattcgcgggatcagcacccactgcaaccactccagtggttccatggtgtccataaagaacggttgagtactgttaaattgatgcggcaggggttcatcgtttcgccagtgctgatgttcacgcagtaacgcttcaagcgcctgcaactggagacgaacgcggtcatgagtggtcataaagcaacctcaataagaaaaactgccgcgaagaatagcaggaataaaaaaagggagcactgtattcacagtgctcccggttcgtttcgcagcattccggctacttttattgctccctgctcatccttgacaacttttcctctggccttgcggccaatcgttcatcctgaactattgcttcctgctcacaccaccccgatgtgatacttcatcctgaagtgttcctggccttcctgacccaccgaatcatcctgaccggttctcattctccatcctggaggtgtcctttaacgcgtcctgcgtcatcctcttcgcttcatccagaagcctttccctgaaacaccatcctggtgtgtccttcagaagtgtcatcatcctgatgttcacttcgttgtctgactccctgtcgacgaagatagaatcgtctttttctcgaagtcttacaaggcgcttacagacaatgccttaaggaaaatttcatatgaaagttaagaattaacaagcaacatgttgtttttaaatgagaataacgattcttatctttttaagtattcgcttatttcctggcgatctcctacagagtctgtaagagatctctcacaaccagatggggtatttggattacagaagaggcttaagttgattaaggaattccgcaagatttgaggctaaatgcgtccgtttacgtgttcccagcgtctctttgcacacttcaccggagagattacacaccgagatgacctctaactcttcttccagcgtcgcgataaatagcgtgggcggcagttttagccttttctgagtcaccagatgaccaatcagattttcctgcacccgacggaagtcgtcttcactccaggtttgcagcaatgtcagtttgatatcgccaaactgcgcgtgcatatccccggcaaactgagtcgtataaaaggtatgaatcgtgggttgtatcacaatatcaaaagcgcgttcaaccgcgtttacattttgttccccggtaaacggctggggttgccagtatacggcatcttcggtagttgaaataatgcacggtgaaggaacgccgtacagttcctcacttaacggccagcttttatgctcttcatgccacgcatcgcagtagcgtgcagtaaaatctttcagggcttgtgcggtcaaatcgtccactaatttctctcttcacttaaaccagatacacttgtcgtttagtttatctggtttatgacggtgaaacatgtcttcttatgcaaaccatcaggcacttgcgggcctgacacttggaaaatcaaccgattaccgggatacctatgacgccagcctactgcaaggcgtaccacgcagcctgaatcgcgacccgctgggtctgaaagcggataacctgccttttcacggtacggatatctggacgctgtatgaactttcctggctgaatgcgaaaggtttgccgcaggtcgctgtcggtcatgttgaacttgattacaccagcgtaaatctgattgagtcgaagagttttaagctctatctcaacagttttaaccagacgcgttttaataactgggatgaggtgcgccagacgctggagcgcgacttaagcacttgcgcccaaggtaaggttagcgtggcgttatatcgtcttgatgaactggaaggccagccgataggtcatttcaatggcacctgcattgatgaccaggatatcactatcgataactatgaattcactactgactatctggagaatgccaccagcggtgaaaaagtagtggaagagacgcttgtcagccacctgctgaaatcaaattgcctgatcacccatcaaccagattggggatcgatccaaattcagtatcgtggacgccaaattgacagagaaaaactgctgcgttacctggtttctttccgtcatcacaacgagttccacgaacagtgcgtggaacgcatctttaatgacctgttacgcttctgccagccagagaaattgagcgtttacgcacgttatacccgtcgtggcggtctggacattaacccgtggcgcagtaataacgattttgtcccatcgaccacaagactggttcggcaataaattttttctcaattttgcgtgctggattcacgcagaaggttgtgaaaggtcagcaggcagggctattgtaatcaaagggaatgacgatattcgtcccataaggagtttttcttgattacacatattagcccgcttggctccatggatatgttgtcgcagctggaagtggatatgcttaaacgcaccgccagcagcgacctctatcaactgtttcgcaactgttcacttgccgtactgaactccggtagtttgaccgataacagcaaagaattgctgtctcgttttgaaaatttcgatattaacgtcctgcgccgtgaacgcggcgtaaagctggaactgataaatcccccggaagaggcttttgtcgatgggcgaattattcgcgctttgcaggccaacttgttcgcggttctgcgtgacattctcttcgtttatgggcaaattcataacaccgttcgttttcccaacctgaatctcgacaactccgtccacatcactaacctggtcttttccatcttgcgtaacgctcgcgcgctgcatgtcggtgaagcgccaaatatggtggtctgctggggcggtcactcaattaacgaaaacgagtatttgtatgcccgtcgcgtcgggaaccagctgggcctgcgtgagctgaatatctgcaccggctgtggtccgggagcgatggaagcgccgatgaaaggtgctgcggtcggacacgcgcagcagcgttacaaagacagtcgctttattggtatgacagagccgtcgattatcgccgctgaaccgcctaacccgctggtcaacgaattgatcatcatgccagatatcgaaaaacgtctggaagcgtttgtccgtatcgctcacggtatcattatcttccctggcggtgtgggtacagcagaagagttgctgtatttgctgggaattttaatgaacccggccaacaaagatcaggttttaccattgatcctcaccggcccgaaagagagcgccgactacttccgcgtactggacgagtttgtcgtgcatacgctgggtgaaaacgcgcgccgccattaccgcatcatcattgatgacgccgctgaagtcgctcgtcagatgaaaaaatcgatgccgctggtgaaagaaaatcgccgcgacactggtgacgcttacagctttaactggtcaatgcgcattgcgccagatttgcaaatgccgtttgagccgtctcacgagaatatggctaatctgaagctttacccggatcaacccgttgaagtgctggctgccgacctgcgccgtgcgttctccggtattgtggcgggtaatgtaaaagaagtcggtattcgcgccattgaaaagtttggtccttacaaaatcaacggcgataaagagattatgcgtcgtatggacgacctgctacagggttttgttgcccagcatcgtatgaagttgccaggctcagcctacatcccttgctacgaaatctgcacgtaatctcccctcccccggtgacgtttgttgccgggttttctcatttttggtcacttactcatcaactcatttcatttgttatatgaatgtttcttactaccctcacgcgacaaatatcaccacagttaatatgtcatacaatttatgttgaaacgcaaacgtttccctattttcataaaccatattttattgccatgaaaaagaaattatcgccatgattgactaaaagtattgattttttcagttcaacctacatatattgcgcgccccgtaagaagtcagatgtcgtttaatgggtaaatattgcccttaaattctcttttacttttgatttacagagtaaagcgttgtgattatctatcttccaagtagattattgtatttgggatcaagatcactgatagatacataacttgtgtgtatctttccgccctcaaattattacggtggaaaatgattaagccatcgccgatagacagatttcatttttacggtcaggcaccttcccgggctgaactggctaaaagctgaattatttgcattcctccaggagaaatagatggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgctggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattactctgctctacttcttcgctatctacccgatcctgctggtttatagcgtggcaatcaccaatacagttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgcagcactggaaacgctgtctctggacactgcatctgcaaccggaaacggtctgtggatgacactgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtgatgttcttcgtcttcagctgcgtactgagcctgactccggcagacctggctgcggctaaagagcagaacatctcgattctgtcttacctggctaaccactttaacgcgccgatcatcgcgtggatggctccgattatcgcgattatcgctatcaccaaatccttcctcggccactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggcccaatcatcgcgatgatcctgttcctgatgccgatgtacgcaattcagaaagtaccggcaatgcgtaaatacagcggtcacatcagcaacgtattcgttgtcgtgatgggtctgattgcaatctccgcaatcttctactctctgttcagctaagtcctttcgcgccgctttcgggcggcgcttcctccgttttaacgcgatgtatttcctatgattagcgtattcgatattttcaaaatcggcattggcccttccagttctcataccgttggaccaatgaaagcgggtaaacaatttaccgacgatctgattgcccgtaacctgcttaaagacgtgacccgcgtggtggttgacgtgtacggctcgctctctctgaccggtaaaggccaccacacagatatcgccataattatgggtctggcgggtaacctgccggataccgtggatatcgattccatccctggttttattcaggatgtgaatactcatggtcgcctgatgctggcaaatggtcagcatgaagtggagttcccggttgatcagtgcatgaacttccatgccgacaacctttctctgcatgaaaacggtatgcgcattaccgcgctggcgggcgataaagtcgtttacagccagacttactactctattggcggtggctttattgttgatgaagaacattttggtcagcaggatagcgcaccggttgaagttccttatccgtatagttccgctgccgatctacaaaaacattgtcaggaaaccgggctgtcactctctggcctgatgatgaaaaacgagctggcgctgcacagcaaagaagagctggaacagcacctggcgaacgtctgggaagtcatgcgtggcggtattgagcgcggtatttctaccgaaggcgtgttacctggcaaactgcgcgttccacgccgtgctgcggcactacgccggatgctggtcagccaggataaaaccaccactgacccgatggcggttgttgactggatcaacatgtttgcactggcagtgaacgaagagaacgctgctggcggtcgcgtggtgactgcgccgactaacggtgcgtgcgggattatcccggccgtgctggcgtactacgacaagtttatccgcgaagtgaacgctaactcactggctcgttacctgctggtagccagcgccattggttctctttataagatgaacgcctcgatttctggtgccgaagtcggctgccagggtgaagtcggcgtggcgtgctcaatggcggcggctggtctggcagaactgctaggcgcaagcccggcgcaggtatgcatcgcggcggaaatcgccatggagcacaacctcggtctgacgtgtgacccggtcgccgggcaggtacaggtgccgtgcatcgagcgtaacgccattgcggcagtgaaagcagtaaacgctgcacgtatggcgctgcgccgtaccagcgagccgcgcgtctgcctcgataaagttatcgaaactatgtacgaaacaggtaaagatatgaacgccaagtaccgcgaaacctctcgcggcggcctggcaatgaaaatcgttgcctgcgattaatcgctctccagaggcctctttttgcgaggcctcttcccgatttctcatccagccatagcctgttctggcatcgaatgttacccttatcgcctgatctttaagggggttatcgtggctgttcatttgcttattgtcgatgcactgaatcttattcgtcgcattcatgccgttcagggttcaccctgtgtcgaaacctgccagcacgcgctcgatcagctcattatgcacagccagccaacccacgcggtcgccgtttttgatgatgaaaaccgcagtagcggctggcgtcatcagcgtttaccagattacaaagcgggtcgaccgccaatgccggaagagttgcacaacgagatgcctgcattacgcgccgcctttgagcaacgcggcgtcccgtgctggtccgccagcggcaacgaagccgatgacttagccgccacgctggcggtcaaagtgacacaggccgggcatcaggcaacgattgtttcgacagataaaggctactgtcagttactttcaccgacattacgtattcgtgattacttccagaaacgttggctggatgcgccatttatcgataaagaatttggcgttcaaccgcagcagttgcccgattactgggggcttgcggggatcagcagttcaaaggtaccgggtgttgcggggatcggaccaaaaagcgccacacagctactggtcgagtttcagagtctggaagggatatatgagaatctggatgcggttgccgaaaagtggcgcaaaaaattagaaaaccataaagagatggcgtttctgtgccgcgatattgcccgcttacaaaccgatttgcatatcgacggcaatttacagcaattgcggttggtaaggtaacggcgtgccggatgcaaacgattatcaacacattgaatttaatgcacttatatgccggataagacgcggctagcgtcgcatccggcattatcacatcagcgcatttaccaggcggtatggtaaagctctacaatatcctcaagcgttgcttcacgcgggttgccaccggtacaaacatcatccagtgccgcctgcgccagtgccggaatgtcttccttgcgtacaccaacatcacgtaaatgtggcggaataccgacatcacggttgagagcaaacaccgcttcaacagcggcattacgcgcctcttccaggctcataccttccactttcacgcccataacgcgcgcgatatcgcggtacttctcaccggtaaagtcagcgttatagcgcatgacatgcggtaacaggatggcgttcgcaacaccgtgtggcgtgttgtaaaacgcgcccagtggatgcgccataccatgcaccaaccctaacccaacattcgagaatcccatacccgcaacatactgcccgagcgccatttcttctccggcatccttatcaccaacaaccgatcctcgcagcgccccagcaatgatttcaatcgctttaatgtgcagcgcatcggttagcgcccacgcgccacgggtaatatacccctcaatagcatgagtgagcgcatcgacacccgtcgcggctttcagcgctggaggcataccatccatcatgtcagcgtcaataaacgccacctgcgggatatcatgcggatcaacgcaaacaaacttgcgccgtttctcttcgtcagtgatcacgtagttaatggtcacttctgccgcagtgcctgctgtggtggggattgccagaatcggtacactgggtttattggtcggggaaagcccttccaggctacgcacatcggcaaactccgggttgttgctgataatgccaatcgctttacacgtatcctgtggagaaccaccaccaatagcgatcaggtaatccgcgccgctattctggaatacatcgagcccttctttgacgacagtaattgttgggttaggtactacgccgtcgtaaatcgcccatgccagtcctgccgcatccatcttatcgatcactttcgccaccacgccgcattgcaccagcgttttatcggtgacgatcagcgccttctgataaccacggcgtttcacctcatcggttaaagacccaacagccccccgaccaaaccatgccgtttcgttcagaatcattctgttagccatcatccttctccttgttgctttacgaaattactcttcaatccgtaacccgtaggttttgaatttctccagcactacggcaatctcttcatcgctcagcactggcaccgggtccgtaatcgccagggtcgtcaggtaaagttgtgccagcacttcaacttcatgcgccagccataacgctttctccagattcgcctcacaagcgataagcccatgatgttgtaacaaagttgccttacgatttttgagagccagcgcaacatgttcagaaagttcgcgtgttccaaaggtcgcataaggcgcgcaaggaatagaattaccgccagccgccgcaatcatgtagtgaatcgcggggatcggtcggttaagaatggaaactgccgtacaatgaacggcatgattgtgaacaaccgcgttggcatccggtctgctttgataggccgccatatggaaacgccactcgcttgaggggagttttccttcctcatgtttgccgttgccatcaataaagacaatatgcgactccgtcagtttttcatatggaatacctgtaggcgtaatcagcatcccatcctgataacgtacactgacgttacccgctgtcccctggttcagccccaggcgagtcatttccaggcaagtgtcaataatctgacgagcaagtttatttcgttccattagctacctctctctgattcaaaacagggcaataatgttgttcctttcacactattgaattagccgtttaattacccaccatcttcttcctgattaaccagaaagaaattcacaagcttatattttgtgacctggttcaactaatcacagtaaataactgcaagttctctttttataactccattaaaaatgaccgctcttaaaaatatttatcaaaacggtcatttttctactcctccctgccaggaatgcccgttttcggcacaaacaattaatacggtcatctggtttgtgttttttatgatttattttctgaaacgggcatgaaatttcgattattaaagtgatggtagtcacataaagtcaccttccagctaataagtgtgaccgccgtcatattacagaccgttttttatttgaaaatgaatccatgagttcatttcagacaggcaaatattcactgatatgaagcccgaactcgctggttttgcacttttgaaaacataaccgattacgtgcttaagcttctgaacctaagaggatgctatgggaaacacatcaatacaaacgcagagttaccgtgcggtagataaagatgcagggcagagcagaagttacattattccattcgcactgctgtgctcactgttttttctttgggcggtagccaataaccttaacgacattttattgcctcaattccagcaggcttttacgctgacaaatttccaggctggcctgatccaatcggccttttactttggttatttcattatcccaatccctgccgggatattgatgaaaaaactcagttataaagcagggattattaccggattgtttttatatgccttcggcgctgcattattctggcccgccgcagaaataatgaactacaccttgtttttagttggcctatttattattgcagccggattaggttgtctggaaactgccgcaaacccttttgttacggtattagggccggaaagcagtggtcacttccgcttaaatcttgcgcaaacatttaactcatttggcgcaattatcgcggttgtctttgggcaaagtcttattttgtctaacgtgccacatcaatcgcaagacgttctcgataaaatgtctccagagcaattgagtgcgtataaacacagcctggtattatcggtacagacaccttatatgatcatcgtggctatcgtgttactggtcgccctgctgatcatgctgacgaaattcccggcattgcagagtgataatcacagtgacgccaaacaaggatcgttctccgcatcgctttctcgcctggcgcgtattcgccactggcgctgggcagtattagcgcaattctgctacgttggcgcacaaacggcctgctggagctatttgattcgctacgctgtagaagaaattccaggtatgacagcaggctttgccgctaactatttaaccggaaccatggtgtgcttctttattggtcgtttcaccggtacctggctcatcagtcgcttcgcaccacacaaagtcctggcagcctacgcattaattgctatggcactgtgcctgatctcagccttcgctggcggtcatgtgggtttaatagccctgactttatgcagtgcctttatgtcgattcagtacccaacaatcttctcgctgggcattaagaatctcggccaggacaccaaatacggttcgtccttcatcgttatgaccatcattggcggcggtattgtcactccggtcatgggttttgtcagtgacgcggcgggcaacatccccactgctgaactgatccccgcactctgcttcgcggtcatctttatctttgcccgtttccgttctcaaacagcaactaactgaacatattttccgaataaagtgaggaatctgtaatgaaaaaaatcagcttaccgaaaattggtatccgcccggttattgacggtcgtcgcatgggtgttcgtgagtcgcttgaagaacaaacaatgaatatggcgaaagccacggctgcactgctgaccgagaaactgcgccatgcctgtggagctgccgtcgagtgtgtcatttccgatacctgtatcgcgggtatggctgaagccgctgcttgcgaagaaaaattcagcagtcagaatgtaggcctcaccattacggtaaccccttgctggtgctatggcagtgaaaccatcgatatggatccaacccgcccgaaagccatttggggctttaacggcactgaacgtcccggcgctgtttacctggcagcggctctggcagctcacagccagaaaggcatcccggcattctccatttacggtcatgatgttcaggatgccgatgacacatcgattcctgccgatgttgaagaaaaactgctgcgctttgcccgcgccggtttagcagtcgccagcatgaaaggtaaaagctatctgtcgctgggcggcgtttcgatgggtatcgccggttccatcgttgatcacaacttctttgaatcctggctgggaatgaaagtccaggcggtggatatgaccgaactgcgtcgccgtatcgatcagaagatttacgacgaagccgaactggaaatggcgctggcctgggctgataaaaacttccgctatggcgaagatgaaaataacaaacagtatcaacgcaatgccgagcaaagccgcgcagttctgcgcgaaagtttactgatggcgatgtgtatccgcgacatgatgcaaggcaacagcaaactggccgatattggccgcgtggaagaatcacttggctacaacgccatcgctgcaggcttccaggggcaacgtcactggaccgatcaatatcccaatggcgataccgctgaagcgatcctcaacagttcatttgactggaatggcgtgcgcaaaccgtttgtcgtggcgaccgaaaacgacagtcttaacggcgtggcaatgttaatgggccaccagctcaccggcaccgctcagatatttgccgatgtccgtacctactggtcaccagaagcaattgagcgtgtaacggggcataaactggacgggctggcagaacacggcatcatccatttgatcaactccggttctgctgcgctggacggctcctgtaaacaacgcgacagcgaaggtaaaccgacgatgaagccgcactgggaaatctctcagcaagaggctgacgcttgcctcgccgctaccgaatggtgcccggcgatccacgaatacttccgtggcggcggttactcttcccgcttccttaccgaaggcggcgtcccgttcaccatgactcgtgtcaacatcatcaaaggcctgggaccggtactgcaaatcgcggaaggctggagcgtggaattgccgaaggatgtgcatgacatcctcaacaaacgcaccaactcaacctggccaaccacctggtttgcaccgcgcctcaccggtaaagggccgtttacggatgtgtactcggtaatggcgaactggggcgctaaccacggagttctgaccatcggccacgttggcgcagactttatcactcttgcctccatgctgcgtatcccggtatgtatgcacaacgttgaagagaccaaagtgtatcgtccttctgcctgggccgcgcacggcatggatattgaaggccaggattaccgcgcttgccagaactacggcccgttgtacaagcgttaatacatgactccctgatgtgatgcccggtcgctccggctaccgggcctgaacaagcaagagtggttagccggataagcaatgttatccggctatattgcaggagcgattatgaaacaagaagttatcctggtactcgactgtggcgcgaccaatgtcagggccatcgcggttaatcggcagggaaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgattgccatatccgcggtatcgccgtcaccacctttggtgtggatggcgctctggtagataagcaaggcaatctgctctatccgatcattagctggaaatgtccgcgaacagccgcggtaatggacaatattgaacggttgatctccgcacagcagttgcaggctatttctggagtcggagcctttagtttcaatacgttatataagttggtgtggttgaaagaaaatcatccacaactgctggaacgcgcgcacgcctggctctttatttcgtcactgattaaccaccgtttaaccggcgaattcactactgatattacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggtataccggtgatttccgcaggtcacgatacccagttcgccctttttggcgctggtgccgaacaaaatgaacccgtgctctcttccggtacatgggaaattttaatggtccgcagcgcccaggttgatacttcgctgttaagtcagtacgccggttctacttgcgaactggatagccaggcagggttgtataacccaggtatgcaatggctggcatccggcgtgctggaatgggtgagaaaactgttctggacagctgaaactccctggcaaatattgattgaagaagctcgcctgatcgcgcctggctcagatggagtgaaaatgcagtgtgatttattgtcgtgccagaacgctggctggcaaggcgtaacgcttaataccacgcgggggcatttctatcgcgcggcgctggaagggttaaccacgcaattacagcgcaatctacagatgctggaaaaaatcgggcactttaaagcctctgaattattgttagtcggcggaggaagtcgcaacacattgtggaatcagattaaagccaatatgcttgatattccggtaaaagttctcgacgatgccgaaacgaccgtcgcaggagctgcgctgtttggttggtatggcgtaggggaatttaacagcccggaagaagcccgtgcacagattcattatcagtaccgttatttctacccgcaaactgaacctgaatttatagaggaggtgtgaaatgctgaaaacaatttcgccgttaatttctcccgaactattgaaagtgctggcagagatggggcatggagatgaaattattttttccgatgctcactttcccgcccattcgatgggaccgcaggtgatccgcgctgatggcctgttggtgagcgacttgctccaggcgattatcccgttatttgagctggacagttatgcaccaccgctggtgatgatggcggcggtagaaggtgacactctcgatcctgaagtagaacgacgttatcgtaatgcgctttcactacaagccccctgtcctgacatcatccgcatcaatcgttttgcgttttatgaacgggcgcaaaaagcctttgcgatcgttatcacaggcgaacgagcgaagtacgggaatattcttttaaaaaaaggggtaacaccgtaatctcataccggtacgcccgcatgacgcgggcggttatcgaatgatggggtgaaaaatatgaaagcggcacgccagcaagcgatagtcgacctgctgctgaaccataccagcctgaccacggaagctctctctgaacagctaaaggtcagtaaagaaaccattcgtcgcgatctcaatgaattacagacgcagggtaaaattctgcgcaatcatgggcgcgctaaatatatccaccgtcaaaatcaagacagtggcgatccctttcacatccggctgaaaagccattatgcgcataaagcagatatcgcgcgcgaggcgctcgcgtggattgaagaagggatggtgatagccttagacgccagttcaacttgctggtatctggcacgccagttgcctgacatcaacatccaggtcttcaccaatagccatccgatttgccatgaactcggtaaacgcgaacgcattcaactgatcagttccggcggcacacttgagcgcaaatatggttgttacgtcaatccctcgctgatttcccagcttaaatcgctggaaatcgatctgtttattttttcttgtgaagggatcgatagcagcggcgcactgtgggactccaatgccatcaacgctgattacaaatcaatgttattaaaacgtgccgcgcaatcgttgttattgattgataaaagtaaatttaatcgttcaggggaagcccgcatcgggcatctggatgaggtaacgcacattatttctgatgagcgccaggttgcaacttctttggtaacagcctgacggaaagggtagcaggccggagacgacgccccggccttgcctgttatcgctcgtcgcgacgaccacccaccgcagcccagatacggcggacgtgcaccgtcacttcttcgcgatcgtgatacaactgccgcgcctgaatctgagcatttatgccatgttcatcaagctgtgcctgaatatacgccagattgtgtgacacttcttcgtagcgttttttcatcggcagtttgagattgaagatagtttcacggcaccagccattaaccagccactgcgccattaatgccgcaactttcgccggtttttcaaccatatcgcataccatccaggagatattgctgcgtgtcggacggaatttgaaaccgtcttcccgcagccacgtcacctgcccggtatccatcagactttgcgccatcgggccgttgtcgacggaataaacccacatgttgcgcttcaccaattggtaggtccagccgcctgggcaagcgcccaaatccaccgcccacatcccgttcgccaggcgttcatcccactcatccgcgggaataaacacatgaaatgcctcttccagtttgagcgtggaacgactcggcgcatctgccggaaatttcaggcgcggaatgcccatatagaacggcgaattattgctgctgtatgagtaaccagtatagcaacagcctggtgcaataaagaatacatgcacaaccggacgcttcggcgtttcatagttcgccagcacccccgcatcacgcaaggcagcgcgtagcggcacggtgaatttacggcagaatttcagcaactctttgctttcgttggtatcggcaacttcaacacgcagttcaccgcccttctctactacgccctgtaacatgccaacaatgggggtaatacgatcttctggcggcaaatgctgcaggagttcccccactacaaaccactggcgggcaaaaattaatgaactgaacggcagctcacggattaacttatcgccatcatcaggttgataacattcataaatcacataacccgcattctctttcacgcgggcaaaaccgaaaatttcccgctggccggctttatcggtaatttctgcggcgcactctttttcaaagcccggacggcacagcaatataaccttattcatgacttacgcccttgcgctttaaacggatagcaccaactaacattaacgcccagcccgcaaggaagctcacgccgccaaccggtgtgacaaacgcccacaaacgcagatgggacagcgccaggcaataaaggctgccgctgaacagcaccgtgcctaacgcgaggaaaacgctactccagtaaaaccagatactgatgcgacgctgcattgccaccgccagacctaagatcgccagcgtatgaaacgcctggtattcgaggccggtctggatccagcccatctcaacggcccccatggttttacttaacacatgcgcgccaaaagcgcccagagctacaaaaatgaagccgctaatggcggcgaaaatcagcataaaacggctggtcatggtcgtaccctacgtaaattattgttcataacgaaagcggaatttttcttgttcagcagcggctttcgccaggatccattggcgaaaggcggctattttacccagttctgcctggctgtcatgacaaaccagataaaaagcgtttttactgaccagaacatcattaaacgggcaaacaagacgtccggcctcgatttcagattgcgccatcacgttatttgccagcgccactccctgcccgtggatagccgcttgcagcaccatggcgctatggctaaaaattggcccttgctgaacgttgatatgatttaaccccaactgtcgggtatatgtctgccagtcacggcgtgacgcatcatgtaataacgtatgtttagccagatcttccggggtcttcaagggtttttcgccagtcagcagtagcggcgagcacaccggcaataaatattcggcgtacagtttttccacccgtagccccggccagttgccccgaccataaaatatcgccacatcaacatcatccgccagcttatcttcctgacgatcaaccgcctggattcgaacgtcaattcccggataagctgaattaaagctggaaagtcgcggaaccaaccaatgaatggcgaaactggggagtaaactgaccgtcaacgcccccttagcgctacgggcctggagtttacgcgtcgcttcggttaattgcgaaaatatctctttgatatcgaggaaatagctttgcccttcctcggtcagcaggagtgaacgattacggcggcggaacagttttagccccagaaaatcctcaagagacttgatttgatgacttactgcggcctgggtcacaaaaagctcttctgctgcgcgagtgaaacttaaatggcgtgctgcggcatcaaaaactcgtaaggcatttagcggtggtaatcgtttagacatggcttttaaactttgatgttaaatgaatttaacaattagattacactgtgtaacctattagtttttttaatctgagccattataaattgtccgttgagcttctaccagcaaatacctatagtggcggcacttcctgagccggaacgaaaagttttatcggaatgcgtgttctggtgaacttttggcttacggttgtgatgttgtgttgttgtgtttgcaattggtctgcgattcagaccatggtagcaaagctaccttttttcacttcctgtacatttaccctgtctgtccatagtgattaatgtagcaccgcctaattgcggtgcttttttttaccttgcgatcgcgaattactgatccagttcgaccatctctttcacgtcggtacggttgatctgctgtttgttgccattagcgtctttatacgaaatcataccggtatcgttatcagtctgtggtttgccgtcagagacgatggtacgtccgtcattggtgtgcatcacatagttcgaaccggaacaggcgctcagggcaaaagtcagcatacaggcagaaataattgcggcagtctttttcatcatcttctccttaaagcgattaataaatcttaatagtattgattaacaggctaaaattaacgcctaacactattcagcatatgttactgacgcggcttcgccaggatatccagataattctgatggttagcactctccttgtatcaaagtgaattttgcgtcacgatcggtgcatcaagccgaggagtaccatgaacgtttttaatcccgcgcagtttcgcgcccagtttcccgcgctacaggatgcgggcgtctatctcgacagcgccgcgaccgcgcttaaacctgaagccgtggttgaagctacccgacagttttatagcctgagcgccggaaacgtccatcgcagccagtttgccgaagcccaacgcctgaccgcgcgttacgaagctgcgcgggaaaaagtggcacaattactgaatgcatcggatgacaaaaatatcgtctggacgcgcggcaccactgaatccatcaacatggtggcgcaatgctatgcccgtccgcgtctgcaaccgggcgatgaaattattgtcagtgtggcagaacaccacgccaacctcgtcccctggctgatggtcgcccaacaaacgggggccaaagtggtgaaattgccgcttaatgcgcagcgactgccggatgtcgatttgttgccagaactgattactccccgtagtcggattctggcgttgggccagatgtcgaacgtcactggcggttgcccggatctggcgagagcgattacttttgctcattcagccgggatagtggtgatggttgatggtgctcagggggcggtgcatttccccgcggatgttcagcaactggatattgatttctatgctttttcaggtcacaaactgtatggcccgacaggcatcggcgtgctgtatggcaaaccagaactgctggaagcgatgtcgccctggctgggcggcggcaaaatggttcacgaagtgagttttgaaggcttcacgactcaatctgcgccgtggaaactggaagcaggaacgccaaatgtcgctggcgtcataggattaagcgcggcgctggaatggctgacagattacgatatcaaccaggccgaaagctggagccgtagcttagcaacgcttgcagaagaagcgctggcgaaacgtccaggctttcgttcattccgctgccaggattccagcctgctggcctttgattttgcgggtgttcatcacagcgatatggtgacactgctggcggagtacggtattgccctgcgcgccgggcagcattgcgctcagccgctactggcagaattaggcgtaaccggcacactgcgcgcctcatttgcgccatataatacaaagagtgatgtggatgcgctggtgaatgccgttgaccgcgcgctggaattattggtggattaatgacaaacccgcaattcgccggacatccgttcggcacaaccgtaaccgcagaaacgttacgcaataccttcgcaccgttgacgcaatgggaagataaatatcgccagttgatcatgctggggaaacagcttccggctttgccagaggagttaaaagcgcaggctaaagagattgccggatgcgaaaaccgcgtctggctgggatataccgtggctgaaaacggcaagatgcatttctttggcgacagcgaagggcgcattgtgcgcggcctgttggcggtgttgttgactgccgttgaggggaaaaccgccgccgaattgcaggcacagtcgccgctggcattgtttgatgagctgggattacgtgcgcaacttagcgcctcacgcagccaggggttgaatgcgttaagcgaggcgattatcgctgcggcgaagcaggtttaagcacagaaccaggtcggataagacgttcgcgtcgcatccgacctgattgtttacccctgacacgccgctttcgccatcatcttcttcagcgcatgagaaaccgcaacaaagccaaaagtggcggtcaccatcgtcgccgcgccaaatcctgaggcacaatccatccgctttggcccttccgccgtggctttcatcgcacagacggtgccgtctgactgcgggtacaccagcgcttcggtagagaacacgcaatccacgccgagcttacctttactgtttttcactacgccaaaatcgcttttcaggcgctcgcgcaacttcgccgccaacgggtcctgaatcgttttcgccagatcggtaacctgaatctgcgtcgggtcaatctgcccaccagcgccaccggtcgtgaccagcgggattttattgcgccgacaataagcaatcagcgccgctttgggccgtacactatcaatagcatcaatcacgtacgaataaccggcattcatatattgcgctacgttatccggcgtcacgaagtcatccaccaccgttacacggcactccgggttaatctggcgaatacgctccgccattacttccgcttttgccagcccgacgttatcgcgcagagcgtgaatttgccgattggtattggtgacgcacacatcatccatatcgataagcgtgattgcgccaatccccgtgcgcgctagcgcttccgccgcccaggaaccgacaccaccgataccaaccacacaaatatgcgcgtcagcaaacagttgcaatgctttttcaccatacagacgcgctgtgccaccaaaacgctgacgccatgcatcactaattaccacagacatagcacctcagaattaaaaagggtgaggttacccctcaccctgtcatatccgtaaaaacggcatacagaatatcacatcagccgctaaagacgttacctgcgcccggggcggttttcagcacccagacacgtccatagtggttgtaccaacctgcgcggtgtccggcttccggcccgatcccttgatagatatcgaagtgttggcctttgattgcgccaccgacatccagcgccaccatcagacgcaattcgtactgaccgttaaatttgccgttattatccagcagcggcacttctgccagcaaggtagtacctggcggaataattgaacgatcggaggcaacagaagcacggccaaccagcggcaccgcacttgcccctttcaccggtgcaaaagattgcggtttaaagaagacgaaagacgggttctgttccagcagctcgcgaacctcagcttcactgtgtgtttcgccccagtgacgaatcgcctgcatcgacatatcttcttttttcacttcgccacggtcgatcaacaccttaccaatgctgcgataggcatgaccgtttttccctgcatagctgaaaaagttaagcggactgccatcaccaaagtcgatatacccgctaccctgcacatccataatgaagttatccatcagggagttactgtaagcgagaatatatttatcactcagagctcctgcgtagatctccgcacgagacggcagacgaccacgttttggcggcatacggtaaatcggatactggaactcgccctgacgggtatggcgcgcctgaattaccggcgtgtaatagcctgtaaactgcacgttaccatagttgtcgacaccttccatctgccaggcatcaatgccgaactggcgcatattgcgggtatcaccgcctgcgcgcagccactcttgcaccgcgttataaacattactctggttgccatacagacgcggtgacgaattacggatatggttaatttgctcggcaaaatcaccggcattaatcggcgcgccaacggcatctggctggttcaccagagagaaaggctgggtaaatttcccgtctttatattgctgtccgcgatcggttggtttggaagagcaggcggcaagcattgccacaaccgtgcccataagaaggtactttacccaacgtcctttcattgttctcttcttcaggttaaaaaataaggcgcaacgaagataacaaaccaccgcgtttaatgaaatgagcagcctctccctgacgcaaattttgcacaaaaaataggctttagtgatttgtttttgttcaaaatcatgccaaatccgtgatcggggtaaaaaaaaggttgcatgaaaacgcgagcagagtatagtgcgcatccacggacgcggggtggagcagcctggtagctcgtcgggctcataacccgaaggtcgtcggttcaaatccggcccccgcaaccaattaaaatttgatgaagtaaagcagtacggtgacgcggggtggagcagcctggtagctcgtcgggctcataacccgaaggtcgtcggttcaaatccggcccccgcaaccaatcaaaatttgatgaaataaagctgtgcggtgacgcggggtggagcagcctggtagctcgtcgggctcataacccgaaggtcgtcggttcaaatccggcccccgcaaccaatttattagaatgctgacaaaccgcaaagctactattggcttgcggttttttcgtttttacgcttccttacccgtttcagtgaagcctgagacaatgagtaaaccgttaatatccctccatcaaagccatccatcttatttatatattaaacatataccccattaatgaattttatatattctataaatcaatttattttggttatgttaacatttcaatatcacaacagggcgctacgcttatataatcattgtacaaaaagcacacaactttttaattagtagaaaaattaataattttttgtgaaagcccggacaataagtttaatgaatatcttaatagactctcatactacccaatttcttaaaagtgcaaatttgtgaagcttatcctgttattattttaagtttcatgccaaattctctcaccagataatgccgccctcttccgaaaaataatcaagaggccaagcaatatctaaaatgatacaactgtatctattcccctgaaaaatacattattcatttgtatattttcctcatcattgctttttatttaaatcatccgataatcccctgaatataattatgtcaataaccatcagaaaaagtggatgatgaggaaaaggatatggccgacagtttccagaatgaagttcccgccgctcgtgtaaatatcaagcttgatctgcatacaggcaatgctaaaaagaaagttgaactccccctcaagcttcttgccgtaggcgattacagtaacggaaaagagcaacgtccgctgtccgaacgggacaaggttgatatcaataaaaacaacttcaacagcgtcatggctgagttttcgcctgcggttaatttaacagtagaagatacgctaaacggaaacggtaatgaacaaaatttcgcgcttgaatttaaaagcctgaaggattttgaacccgaacaggtagcaaaaaatattccgcaacttcgtgtattactcgctatgcgcaatttactacgtgacctgaaatccaatctgctggataacgcaacgtttcgccgtgaactggaaaatatcctgaaagacccgacgctcagttcagaactgcgtgatgaactggcgaaaattgcgccgcaggagaacgtttaacccgaacgcgtattcaggttaaaccggagaagaaaggatcactgaaaaggaaatgctgatgtctgtacaacaagaacatgccacctctgaaactgcaacactcaccaccactgagtccggcggcgtttatcagtccctgttcgataaaattaatttaaccccggtctcttccattcaggaaatagatttatggcaaaacagcgaaacgctggctgatgcctcacccgatgagcgcgtgacggcggcgattcacgttctgctttcctgtctggcgaaatcaggcgaggacgtggtcaagctcgacaagagcctgctggattttcatatcgacgatctggatcagaaaatcagtaaacagcttgatgtggtcatgcaccaccctgaattccagaaagtcgagtcgctgtggcgtggtacatggttcgtcgtacagcgcactgattttcgcaaaaatgtcagaattgaattgctggatatcagcaaagagcatctgcgtcaggattttgatgattcaccggaaatcattcagagtggtttatatcgccatacatacattcaggaatatgatacgccgggtggcgaacctgtagcctcattaatatccagctatgaatttgataacagcccgcaggatattgccctgctgcgtaatatttccagagtgtctgccgcttcccatatgccttttatcggttctgtcgggccgaaattcttccttaaaaattcgatggaagaagtcgccgcgattaaagatatcggcaactactttgaccgcgccgaatatattaaatggaagtcgttccgcgataccgatgacagccgctacgtgggattagtgatgccgcgcgtgctgggtcgtctgccctatgggccggacacggtgccggtacgcagctttaactatgtggaagaagtcaaaggcccggatcacgaaaagtacctgtggacaaacgcctcgttcgcctttgccgccaatatggtgaagagctttgtgaataatggctggtgtgtgcagatccgtggtccacaggcaggtggcgcagtggccgatctgccgatccatctttacgatctcggcaccggcaatcaggtcaaaattccgtccgaagtgatgatcccggaaacccgcgaatttgaatttgccaaccttggctttattccgctctcttattataagaatcgcgattacgcctgcttcttctcggcaaactccgcccagaaaccggcgttgtatgataccgctgacgccactgccaacagtcgtattaacgcccgtttgccctatattttcctgctgtcccgcattgcgcattacctgaaaattattcagcgcgagaatatcggctccaccaaagaccgccgcgtgctggaactggagcttaacacctggatccgcacgctggtgacggaaatgaccgatccgggtgatgaactgcaggcgtctcacccgctgcgcgacggcaaggttatcgtggaagatattgaggacaatccgggcttcttccgcgtcagactctttgccgtgccgcatttccagatcgaagggatggacgtcaacctgtcactggtttcccagatgccgaaagcgaaagcctgatcgggcagtggtgtgatatgaaaattcatcgaccactgtgggctgaggggacattcctgtcctctcagcagtttcagcagcaggcccgctgggaagcgttcagcaatgactgtattgcgcagctttgtattcgccatccgtgggggatcgcaaacgtgctctttgaccgggatgccctgacgcccggaaagctgaaaacgcaggcagtacgcctgcgttttgctgatggcacgctgatcgattcagacgtgagtgacgttctgccgctcgcctgcgatctgcgcgcgctgaagaacgacagcgcgattgttttgctggcgctgccgcttgcacatggtaacggcggtaatctcggtcagggtgagcagactgaaagaccgctgcgctatcgtcaggaatggcaaaaggtgcaggatatctacggcagtgacagtgaagatatggccgttgagcgtcatgcgctgtccctgcgctttgctcatgataacaatcaggattacatcacctgcccactggcgcgtctggtgcgggatgttcagggcaactggacacaggatgagagctatattccgccgttactggcgtttaacgcccatgacgggctggtacagcgtctggacacattgctgttgcagctacgggcgaagtgccagcgtctgatggcgatgcgccgggaaagcaaccagcgtatggcggactttgccgtcgccgatgtctccctgttctggctgcttaacgcgctgaattccgccgagccggtgctgagcgatttcctgcgctacccggctgtccaccccgaactggtctggcgggagctggcgaggcttgccggtgcgctgctgacgttttcccttgagcataacgtcagcgccgttccgccctatgtccacgaatcgccgtccaccgtctttccgcccctgttctccctgctcagcgagctgctggaagccagcctgccgtcgcgggtgatcgcgctggatctggcgtccctgccgggcaaccgctggaaagccgacctgcacgatccgcgcctgcgggaagaggccgatttttatctgtccgttcgttcctcactgcctgcgcatcaggtactgcatcagctaccgctggtctgcaaaatcggtgcgcccgatgatgtcacgctgcttatcaacgtggcgctgaacggtgttcaactggtgccgcttacctcggttccggcggcgctgccgctgcggctggagaaccagtattttgcgctggatatgcacagtgacgcggctaaatcgatgctggagtccgggagctgcatgatttatgcgccgggaaccatgggcgacctgaaacctgaactgtttgcggtgctgcgcacatgaaaaaagatatggatatcaatatcgatgcgctgctgcgcgacacgtttctgacggtggtggaactgcgtcagggaaccaccgtgcgtcacggtatcgagctgtatcgccactgtcagcggcaggtggaactggtccgcgaacgtctgaaagatgccggattcagtcgggagaacgtggagcacataacttacgcgcagtgcgccctgctggacgaaacggtgctcagccgtagtggcatggacgacggtcaggccatctggatgaaaaacccactccagtcgcatttcttcaacaccctgcaggccggtgagctgctgtacgagcggatgaagcaggtgctacaggaacccgcccccgcgcaggccgtgctgacctgctttcaccgtgtcctgctgctgggatttcgcgggcgttatcaggatccggcagccccggagcgcgaccagcttatttcgacgctcaacgggcaggtcgcgccatttggtgtgctgccggaaacggcggtactgaacgtgccgttatccacccgtcagcaccctttgctgcattcgccatttttctggctggtaacactggcgctgctactggcgggcgtctggtgggggctacaccactggctgaatgtactggtggatgaactgctgccgcaaagcctgcgttaaagggagtcgtgagtgaggaacacgctgaaacaggccatcgtgctgtggggaatggtgttactgctggtgctgtggtcagtgtttatcagtccgtctggcgtgctgagatgggccggtgcggcggctatcgttctggcggttgctgcgttgttgatttatcggcgcaggcaggcgtggacggagatgaccggcgatgccgggttgtcatcgctgccgccggaaacctaccgacagccggtagtgctggtctgtggcggtctgtcggcgcacctgttcactgacagcccggtccgccaggtttcagaagggctgtatctgcatgttcctgatgaagaacagcttgtggcgcaggtggagcgattgctgacccttcgcccggcgtgggcatcgcagcttgccgtggcgtataccatcatgcccggcatacaccgggatgtggcggttctggccggacggctgcgacggttcgcccacagtatggcgacggtgcgtcgtcgggcaggcgtaaacgtcccctggcttctctggagcgggctgtccggctcgccgttgccggagagaacgaattcaccgtggtttatctgtaccggcggcgaagttcaggtagcaacatccgctgagaccaccacgcccgcgcagtggattgcacaatctggcgcacaggaacgcagtcagcgactctgttacctgctgaaagctgaaagcctgatgcagtggctgaatcttaatgtgctgacggcactgaacggcccggaggcgaaatgcccgccactggcgatggccgtggggctggtcacctcgttgccagcggtggataacaacctgtggcaagtgtggatcaccgccagaaccggcctgacgacggatatcgcggacaccggcacagacgccacgctgccgtttccggatgctctgttacggcagttgccgcgccagtcgggctttaccccgctgcggcgggcctgcgtgaccatgctgggcattaccaccgcggcgggtatcaccatgttgtgcctgtcagccacggcaaatcgccagttattacggcaggtcggtgacgatctgcaccggttttatgccgtcccggtggaggaatttatcaccaaagcccgtcacctgtcggtgctgaaagacaatgcgaccatgctcgatgggtattaccgggaaggagaaccactgcgcctcggtctggggttataccccggcgaacgcatccgccagccggtattacgcgccattcgcgactggcgtccgcctgaacaaaaaatggaggtgacggcttcgcttcaggttcagaccgtgcgtcttgacagtatgtcgctgtttgacgtcggacaggcccgcctgaaagacggctcgacaaaagtgctggtggatgcgctggtgaacatccgggcaaaaccgggctggctgatcctcgtggccggatataccgacgccaccggcgatgaaaaaagcaatcagcagttatcgctgcggcgtgccgaagcggtgcgcaactggatgctgcagaccagcgacatcccggccacctgttttgccgtacagggactgggcgagagccagcctgcggcgaccaacgacacgccacagggccgggcagtcaaccggcgtgtcgaaatcagtcttgttccgcgttctgacgcctgtcaggacgtgaaataaaacataccgccggaagaaggcggtgcttcaatcacactaacaaggagagtaattctcatggctattcctgcttatctctggctgaaagatgacggcggcgcggatatcaaaggttccgtggacgttcaggggcgcgaaggtagcatcgaagtggtggcgctggatcacgatgtgtacatcccgaccgacaataacaccggcaaactgaccggtacccgtactcacaagccctttacgtttaccaaagaaatcgatgcctccagcccgtatctctacaaagctgtgaccaccggacagaccctgaaaacggcagaatttaagttttaccgcatcaacgatgccggtcaggaagtggagtacttcaacatcacgcttgataacgtcaagctggtcagagtcgctccgcttatgcacgacatcaaggatccttccagagagaagcataaccacctggaacgtattgagttccgctacgagaaaatcacctggacttacaaagacggcaacatcattcattccgactcgtggaatgagcgtccttccgcctgataactgcggcagacaggaaactgtctgcctttctgttgtgtgctttgtccagtgccgcaggcaccggtactgagcaaagcatacccacaatctggtgaaacctgatgggcctgagtgaggtaacggctatgggcggtagcgtgcctgaacgcggatcgcaggaatacagaacacgataaggaaacccttctatgacaggaaatcaccccgccgcgctgctgcgtcgccttaacccatactgtgcacgggcgctggacgccgccgcctcgctgtgtcagacccgcgcccatgcggaaataaccattgaacactggctgctgaaactgctggagcagggagaaggcgatatcacggtgattgcccgccgctatgaatgggatatcgacacgctctggcagtctctgctggcacatctggacaccttaccccgcccggtccgcgaacgtcctcaactttctgaaccgctggcagcgcttatccgacaggcgtggctgatagcgtcactggaaggcgacgatccacaaatccgcagccagcatctgctgatggcgctgacagaaaaaccgatgctgcccgcctgtaatgacctgtgggtattgctgagtctgagccgcgtgcagcttgagcggctgcgtcccctgctggatgcgcagtcggatgaatgtccggcacgtcagccacaggtcaccgaaccgctgacctctgcactgccggagacggcaacggcggacgcaccggcaaaaacgctgacggagaaacaggatgacgccctgctggcggtgcttaaccgctttaccgaagacgtgacggaaaaagcccgcagcgggcgaatcgacccggtattcgggcgcgacacggaaattcgccagatggtcgatatcctctcccgtcgccgcaaaaacaacccgattctggtgggagaaccgggtgttggcaaaaccgcgctggtggaagggctggcgctgcgtatcgccgaaggcaacgtgccggacagcctgaaaacggtgcatatccgcacgctggatttggggctgttgcaggccggggcgggtgttaaaggtgaatttgaacagcggctgaaaaacgtgattgacgcggtgcagaaatcgccggagccggtgctgctgtttattgatgaagcccataccattatcggcgcggggaatcaggcaggcggcgcggatgcggcgaacctgctgaaaccggcgctggcaaggggcgaactgcgcaccatcgccgccacaacgtggagcgaatacaaacagtattttgagcgcgacgccgcgctggagcgccgcttccagatggtgaaagtggacgagccggatgatgacaccgcctgcctgatgctcagggggctgaaagcccgctatgcgcagcaccacggcgtacatatgctggacagcgccattcagaccgccgtgcgcctgtcgcgccgctatctgaccggacgccagttgccggacaaggcggttgatttgctggataccgccggggcaagagtccgcatgagcctcgacaccctgccggaaccgttgacgcagcttcatgcgcgactggcggctctggatattgagcgggaagcgattgagcaggactgcgtgttttatcccgaagccagcccagagcggctggcggaactgaccgatttgcgtgatgagctacaggcagaagccgggcatctggaagcgcagtatcagcaggaaaaggcactggcgcagcagattatgacgttgcgtcaggaagggacagacagcactgaactgcaacagcaactgcgaacgcatcagggctttgcaccgctgctggcgctggatgtggacgcccgcgccgtcgccacggtggtggcggactggaccggcatcccgctctcttccctgctcaaagacgagcagagcgacctgctcagtatggaaaagagccttgaaaaccgcgtggtcgggcaaagcccggcgctctgcgccatcgcacagcggctgcgggcggctaaaaccggcctcacgccggagaacggcccacagggggtattcctgctgaccggccccagcggcaccggtaaaaccgaaactgcgctcacactggccgacaccctgtttggcggtgaaaaatcccttatcaccattaatctttcggaatatcaggaaccgcataccgtttcccagttgaaaggttcgcctccgggctatgtcggctacggtcagggcggcgtgctgaccgaagcggtacgcaaacgcccttacagcgtggtgctgctcgacgaagtggaaaaggcgcatcgcgacgtgatgaacctgttctatcaggtgttcgaccggggctttatgcgcgacggcgaagggcgggaaatcgacttccgtaacaccgtgattctgatgaccgccaatctgggcagcgaccacatcatgcagctgctggaggaaaaaccggacgccacggacgcagacctgcatgaactgctgtaccccctgctgcgagaccattttcagcctgcactgatggcgcgctttcagacggtgatttaccgcccgctgggacaggaggcgatgcgcgccattgtggaaatgaaactggcgcaggtggcccgccgtcttcaccagcactatgggctggaaacggaaatcagtaacagcctgtacgacgccctgaccgccgcctgcctgctgccggacaccggtgcgcgtaatatcgacagcctgctgaaccagcaaatcctgccggtcttaagccagcagttgctggcgcagcaggccgtgcatcataagcctgcccgactgcggcttgactgggatgatgaagacgggattgtgctggaatttgatgagaaataatggaggctcttatgaacgtacagttcttcgaccacgcacaccacaagctcaaaattcgcggcctgcaaagtccggtggacgtgctgacttttacaggccgcgaacagctcagcgccccgttccgctacgacattgagtttaccagtaccgataaagccatcgcgccggagtcggtgctgatgcaggacggcgcattcagcctgagcgccccgcccgtacagggaatgccggtgatgacgcccctgcgcaccctgtacggcgtcattaccggctttaagcatctctcctcgtcacaggacgaagcccgctatgaagtgcgtcttgaaccccgtatggcgctgctggcccgcagtcgccagaacgccatttaccagaaccagacggtgccgcaaatcgtcgaaaaaatcctgcgcgagcggcaccagatgcgcggtcaggacttcgtgtttaacctcaaaagcgaatacccggcccgcgaacaggtgatgcagtacggtgaggacgacctgacgtttgtttcacgcctgctgtcagaggtgggtatctggttccgctttgccaccgacgcccggttgaaaatcgaagttatcgaattttacgacgaccagagcggctacgagcgcgggctgacgctgccgcttcgccatccttctgggctgtttgatggtgaaacggaagccgtatgggggctgaacaccgcgtacagcgtggtggaaaaaagtgtctccacgcgggactacaactaccgtgaagccacggcggaaatgaccacaggccagcatgacgccaccgggggcgataacaccacttacggcgaagcctaccactatgccgacaacttcctgcaacaaggcgataaagaggcagcggaaagcggcgcgttttacgcccgtatccgccacgaacgctacctgaatgaacaggccattctcaaaggccagagcaccagttcactgctgatgccggggctggagataaaagttcagggcgacgacgcgcctgcggtgttccgcaagggcgtactgattaccggcgtgacggccagcgcggcgcgtgaccgcagctatgaactgacgtttaccgctatcccgtactcagaacgctacggctaccgtccggcgctaatcccccgcccggtcatggccggaacgctcccggcgcgggtcaccagcacggtgaagaacgatatctatgcccatatcgacaaggacgggcgctaccgggtcaacctcgactttgaccgcgatacgtggaaaccgggttatgaaagcctgtgggtacgccagtcgcgcccgtatgcgggagacacctacggcctgcacctgccgctgctggcgggaacggaggtcagcatcgcctttgaggaaggcaacccggacaggccgtatatcgccggggtaaaacacgactcggcgcacaccgaccatgtgaccatccagaactacaagcgcaacgtgctgcgtaccccggcgaacaacaaaatccggctggatgacgaacgtggcaaagagcatatcaaggtcagtaccgagtacggcggcaagagccagctaaacctcggtcatctggtggacgccgggaaacagcagcgcggggaaggctttgaactgcgtactgatctgtggggtgcggtgcgggcaaagaaagggatttttatcagcgccgacgcgcaggacaaggcgcagggtcaggtgcgcgaaatggctccggcgatggcaatactggatggcgcacagtcacagatgaagtcgctgtccactgatgcgcagacggcgaatgccgatccggcagatctgtcatcacagatagcgctgttgcagcaaagtgtaaaagatctgactcaggctgcgatcctgctaagcgcacccaaaggcgtggcgatcgccagcggagagcacctgcaactggcggcatcgaaaaacctgatcgcgaacgcaggaaatcacgctgatatcggtgttgtgaagaatatgtttatcggtgtgggtcaggcgctgagcgtgtttgtgcgcaaagcgggcatcaggctgtttgccaacaagggggcgatctcggtacaggcacagaacgatctgatggaactgttggcacagaaatcgatagtgatcaccagtacggaagatgagatcaagatcaccgcgaagaagaaaatcacccttaacggcggtggcagctacatccggctggatgcctgcgggatagaagcgggaacgccgggagaatataacgttaaggccggatattacgggcgtaaaccaaaggcgaagctgacgccggagttgatggcgtttccagtgattgagagcggggaatttaatgctaagttcctttttactgatgatgatggtctaccttatgccaacacaaaatatattgcatgtttttctgatggcactcaaaaagaaggtattactgatgagaatgggtatacagaaaattttaatactgattccaaacaaacaattgatgtcagattattgaatcaaaatatagacatgatattgggaggcgtgcatgagtaatgatagaggtagttcaagtggtgaaaatcagaaaactgaacaatgcatacaggaatttcaagttacgaatcaattcaagaaaatgatgaaggagtctctagaggaacaaaaaaaggtaattgataaaagggtaaaaacattaacgcactggagtgatgaagcagaagatgaattcaggagaatatttggcgtgccatctgaaaaaataataaccataaaatttaaactgaacggagaagtaacaaaagaaacaaaaagtgcgcgagcagttattcaagaagccgtggacagaatgaaatttatatgtgataaattatctgctgataaaggggagtgcaaagaagttacttttatagataaatatcttgatagtaatgataattactatgataaagatgttactaagtggaagtgtggcaattttgtaaattctacggacaatgatgcttatactgctaacgtcacccctgatcatattataggtgtttctccagacaaatatgtagatgtagtgacaataagaataggccagcggtttgtatgtaaaccaatgacaggaaaggattctaaagtttcatcactttgccatgaattaacacatttagtcagatatggccccaacggtatgtatggcggtatgcaatcagaggatatgcctgttgataaagagctccagaatgcgaaagagtatgacatctttgctgataaattaataaaaaataaggatatgatactctttgaaaatgcatataatattgaacgttattttgaaatagattaattactcatatccatttgctaatcttatcgtttattatatgtaattataaatttatcgttaagcttgacataagtgagtgcatctatgttcttaacaaatacatcgcgttttttatttttatttttatttcttatgcacaagaataaattatatgcatatgataatttctcattcaatgcggatgtacattatggttatggtaagctattatggcatgataaaaaaccagtcatatacccattggcatccttatctgattatacttattataacgaattcgacccatttgaaacgatttattatgtggggcaatactataaaattagcttaaatgagagtaagcgaattcaagaacaaaaggacatttacgcacatcttcaattaaaacataataaatcattaattacagcaaatgtaacgttacataataaaagtaatagttcgtattatgttcatcggatgaatttaccagcaagcatccatgaatcaccttactctcctttgtgcagtggttcttttttaatcgtaacaaataacatacggttagattatataagaaaaattacatgccgatttgatttgtggatgaaaaaatctgactggatagaaatatcacccggagaaaaactctcatacacagtaaatttgaatgactattatgcttttctccctgcaaagcatcaatatgatataggaactgtagagttcacattggtaaatagtaattggttcttagaacagcatatttatgatcttttttttgctattgtggatgaaagacactataagcagtgtaaaaacacttctggcattgttaggaagtatatctataagtcgtggcagttatgtgagacttatcgtgggaggtggagccctttacaggaactcatgaatcgatttcattatgaaggagggagtgaaaatatatttcaaataagaacaaatcaagaaaatataaacattaatggagataaaattaaatctctttattcatcgatgcagtgagcttaatttttgtgggtatatttattaaacacgtatgcacggaatataaaacacattcctctcaaaaacattaataacaatactgaaagaatttaagaattcacatggttttaaattaagctttagatgatatttctgtataaaaaagcaagatgtattttaattagtgcgtacctaagttggtagtgaattacttacatagtttaaacatcctgatattcattacatttatatttcagaataatggattattacaatgcctgtcagacttaacactattcctgatgctgaaccctatcccgcaccgccagcccacattaaatggttgtcagccttattactgatgctgtctgtgggcgtggccctgacttcattattcgccagcgatgaactggcaaaaaacggcccgcatttctgggggctggcctgcggtgtgcctgcctttatctggtcactggttgcttcagttcgctggctgttctttatcacgcagtacattcgggctgatgcctggaataagcgccgggaagaggtgattttgcaggaaacgcgacggggacgacgggcgttacagatacttagtttttccgtacaaaccgcgctgaatggtgattccgttgcagaaactacaacagcatttctggcgcgtcagcaggtgttgaatacttacgctgatttgcgcggagaagataccgtgcgtcgcagtgtcattcccgtattaaccaataaaccggttaccgggcgtttatccgaaattatttcccgccttttttttgatatcagaccgcaattgtttctgctgccccctgattttcatatcaacgtactactggaaattgatgcgccgctttcaggggcctccgtgagaactatctggcaggacgaatggcaaaaagccggactcccggaagcccgtctgttttctgccccggagccggggctggccgccgtggacgactggctggacaactttattcaggaaaaggccgtactgctggtgatttccgtgcgtctggaaccgaagaacccggaacggacggcagaatccgccaccgcgctgttgctggcaaaccggttgacgcaaaccgcgctgacgccgctggccctgctgcatcgtcctgaacgtatcacagatacagagatgatggcgtcaggcattgcacaggcgctggactggatgccggtgcagccagatgccatatccggtatgtggactgccgaactggacagggaacagcgtgccgcgttgttaagcctgaaccagccgtttgctcaggaagccctgatgtacgagctggatgcctttctggggcgctccggaccggctgcgccgtggctgtccgtcgctgcggcaacgctggcggcaatacaatcacaacacccccaactgacgctcagcggcgttcagggcgggcattattcatgggcgaccgtggtgtcgccattcgtttccccacaggaggcatcatagtggttccaggattaaaccgtctccggccccgttcggtttcagggcctgccatcgtcatgaccgtggctgttgtggttgcgctttgcacgtttattcaccgtaaaccggcattgctgggcgttgaaccgggtagctcacagcaaatgtactggatggctggcgtgattgccgctggcgtggtctttctgattatcatgggggtttatcatctgctgaaccgccacgctgccgtacagagctttgaactccgcagacagcttgccgccggggatgactatcgggcggtgacgacaaagaaagccgacagacgtcatccggcaatggtggaactcgccgccttcctgcgcgaccgctacggcccgttctggcggcgtaaaatccgcctgctgctggtgaccggcgagcctgaacaggcagaggccatcgcgccggggctgaccgggcaacactggctggagggcgaccacacggtgctgatatatggcggcaggccatcagcggagcctgatgtcacactgctggccgccttaaaaaaactgcgccgcagccgtccgctggacggcatcatctggccactgacagaagaacagagccgtcagacagcgcaactcgacaaaggctggcgcgagctggtcaacggcagtaagcgactcggttttcaggccccactctatttgtggcaggtctgtgacaacggtgattatcagaccggacgccctctgcaaagcgtcggctgcctgctgccggaacgctgtaccccggaacaactggctgcaatgctggaagcacaaaccctgccactgacggaacagggcatgtcgcagctgctggccgataaccgccatgattttctgctgcgtctggcccatacccttgcagagcggggtatcgctcactggcaaagcgttctgaaaccgctgctggcaggcggcgcattttcctccctgcgtctgcgtggcctgatgttcagcccgccgcttgccgccgtaccggaggccgcacctcatgcgtggctgccgtcgccggtctgggcaggcatcaccggcgataacgcgcggggccgcgcggtgggctttccgtggctgcgtaccgcactgatgtccgctgtctgcgtgctggtgatatggggagccggaatgacgacctcgttcttcgccaaccgcgcgcttgttcaggaaaccggtatccagacggcacgtgcgcttgatacccgcctgccgctggcagaacaactggtggcgctgcataccctgcagggcgaactggagcgcctgcaatatcgtatccgcgaaggtgcgccgtggtatcagcgttttggtcttgaacgtaaccaacaactgctcgccgccgcctttcccggctatgcacaggcggcaaaccggctggtgcgcgacgtggccgttgaccatctgcaacagcaacttaatgcctttgtcgcgctgccgcccaacagtcctcagcgtaccgccaccggtgaacaacgctataagcagcttaaggcattgctgatgacttcccgcccggaaaaggccgacgctgcctttttcagtaccacgctgatggcggacggtctgcgctacgagaatatcccggaaggtgtgcggcagagcgtgttgccgtcactgctgaccttctggacggcgaacctgccggaacacccgcagtggaaaacatcgccgccaccggaactgaccggcgcagtgcgtaaaatcctgctgcgccagattggtgtgcgtaatgccgaaaacaccctctaccagaacgtgctgcaacaggtgtcccgcaactacgccgatatgacgctggcggacatgaccggggataccctcaccgaatctcttttcagtacggaacagacggtgccggggatgttcacccgtcaggcgtgggaaggacaggtcagggaagccatcgagcaggtggtgacggcgcggcgcgaggaaatcgactgggtactcagcgaccgccagcaggatacctctgcggatatctcgccggatacgctgcgtaaccgtctcacctcacgctactttaccgactttgccggaagctggctggcgtttctcaacagcattcactggaaaaaggaagactcgctctccggcattctcgaccagttgacactgatggccgatgcccgtcagtcgccactgattgcgctgacggacaccctcgcgtggcaggcggcggcaggcagggaaaaccgtggtctgtcagactcgctggcgaaatcggcacaggaactgtttaacggcaaggagaaaacgccgcagcaatcccgtgaaggtgacgtgcctgtcgggccgctggataaaaccttcgctccgctgctgcggttgctgggcgataaggccggaggcggcgacagccaactgagcctgcagacctacctcacccgcgtcacccgtgtgcgtctcaaactgcaacaggtgaccaacgcccccgacccacaggagatgacccagcaactggcgcagacggttttacagggcaaaaccgttgacctcaccgacacccgcgactacggacggttaatcgccgccagtctgggcgaggaatggagtggcttcggtcaggcgctgttcgtccgcccgatggaacagtcgtggcggcaggtgctgacgcctgcggcggacagcctgaaccgccagtggcagcgggcgattgtcagccactggaatcaggacttcgccggtcgctatccgttcaaagcctcacaaaacgatgcctctcttcccctgctggcgcagtatctgcgcgatgacgggcgcatcaaccagtttatagccgccaacctttccggcgtactgaaacgtgaaggccgctactgggtggctgacgccatgaacacgcaggggctgacggttaacccggactttatccgcgccctgaaccgcctgcgcgacgtggccgataccgcctttgccagcggcgatgccggaatacattttgaactgcgggcaaaaccggcgcgtgacgtgatgaaaacgcatctggtgattgacggacaggagctggaatatttcaaccagaaagaacgctggcagcgttttaactggccggatgaacagtggcaacccggcgcatcgctgagctggaccagcactcaggcaatggaacgaatactggcggattaccggggaagctggagccttattcgtctgctggaacaggcgcaggtgacaccggtggacagcagcacctttaaagtggtgtggaaagcgcaggacggcctgccgctgaattacctgctgcgggttgaacagggcaaagggccactggcgctgctggaactgaaaaacttccgcctgccgggacaggtgttcctgaccggcaggagtatgaaggatgcggaagaatacggagaagacgccgatgagtgaactgttgcaaaagctgacccgtagttgttttgccgaccgggacgcactggactcggcgcgaacacaggcggcactgtggcagacgtggctgctgccggtgacggcagatacgccggtcggggaagaccccggctaccacgacgatttcctgcgtatccgcgacgaaatgaacaaactttccggcgcggatacggaccttatctgccagcttgccgaatccctgctgctgacgcaggcaaaagacgtgcgcatcgccacttactacatctgggcgcgactgcaccgcgatggcgaacgcggactggctgaggggctggcgctgttagccggactggtggaacgcttcggtgcgcaactgctgccctcgcgcccggcaagccgaaaaatggcgctggagtggctggcaggggaaaagatgctcgacagccttgcccgctacccggaagtggcaaaagaggattttgcgaacattgttgccgctcttaatcaactgacggtttccttcactgcatggcccgaagaccagcattccccctccctgatgccgctgattaacgcgctggaatcacgtctggcgcagtcgggtgggatgaacgcggtggtgccgcagaacagcagcggcgttccggcaccgtcttccccggtggatgcgccacaggtacagaccatcacttccgggcgcgacctgctcgaccaggcgaaagtgctggcccgttatctgaacgaacagccgcagggctggctttcagcacaccggctgatgaaaaccctgcgctgggacacggtgcatgaactgccgccggatgtggacggaaaaacccggctggccccgccgcgcacagaatcacgcaaccagcttaagcggctgtatgctcagcagaactggacggaactgctggagcaggccgacctgatgttcagctccggcgtcagccatttctggctggatatccagtggtatctgcatcaggcgctggccaaggcgggcgcaccgtgggacagatggactgcggttatccgtcaggatctggcgcagctgctggaacgcctgccagggctggaaaatctggcatggaacgacggcacgccgttcgccgatgaggtgacgcgcaactggatagcgcagcaggtcatgatgcgggaagacggcgcatggcttgcggggaaagccgctgtaccgacagacgacgccacaaatgacgtactggcgctggagccggaagcactggcgatggcagacagtcagggcgtggaagcggcgctgggctggatacagacccgtccgggcatcaccacggcacgacagcgcctgttattgcggctgctgatggcacgggtggcggaacagtacggtaaaaacgagatggcgctcctgctgctggaagaactggataccgccgcacagggaataacgctgacgcagtgggagccagagctgctgtttgaggtaaaagcccgacagctgaaactgctgcgtctgcgggcgcaccgctatgcggataaagccctgctgaaccgaaaaatggaaattctgctgggaacgctggtggcaatcgatccggtacgggcagcggtactgtgtgatacgcaacataaggactgatggcaatgggaacaggctactttctggtcaggggggacaaaaccacctgcggcggcaaaattattgaaggcgcggacgaccatacgatcatgggtattccgcaggcacgggatatggaccgggtcacctgcggcagatatccgggaatgtttattattgtgggtggcgttcctgaaacagatattcacggcaggctgatggcggggacgctggacagtcagagcagttgcccgtgtaaagcacggtttattgcgtcaatgatggatgatacctatgagacggatgacggggggaacgagccggaacaacatgcgcagtcggcgaaaaaggatctgacttctggttctgattcatcctctgatgatgtaaaactggattacagaattaaattatcaggtaataagatactgacgccactgaatatacctgattataaagaaatgattagcggtggtagtacgaagaatacagaaaaaatagattttaccatcacaaataaaggcgatgagactgaagcgctttctctggaagtgcttgatggtaatgaagtgatttatagtgaacggcagaccggtaaatattgtgataagggagagcatgcctggcaatgggatggttacagtaatcaaggcatactggatacaactaagataaaaagcaaatcactacttgtaagactgattgctttatgtggtgatatgatgataaaagttgattatccattgaaaacttctgcgaatgaggaagattggattgatgtaaaagtagacaagaatcaaaaaatagttgatgtcagttggcgagtagaatttgaagatgatggtgtgagtcataaagatgatcgtattgcacctgtagggtttgaaaaattaaagcaacttgccaaagatggaatggagtattattgggcacgaaatggaatgaggaatcccggaattggcaataatattactactccgcacggtaaatataatgtaaatatctctgtatcaataaatattgacccagccatggattcttttgatttaattgaggagcaagatctagaaagcgtcaggtctagtgcttttatgggacgtatgaacatttatttcaatagagggtattatgaatatggccgtgggtataagaaaggcgcagatcctgtttttaaggctggattagaatttaaacttgatgtagcccatgagactggtcatatgatattaaaaagttacggtgggaatacgtattcatgggagcataaagggacctctaatcttgtaccacctcaatatgcactgcctcattcagtttatccagggactggcgagatagatttaatgaaatattatgatgggcatatatacaccagtgatctatatgcaaggtcggttgctgtcgaaaacgatgtatgtgcaatgatatggttatctcgagtgaaatttcatgattagattaatattctcttttttattatgcacactgtgtgctggatgtttatctcaaccattccattcttgttccattgtcatggtaaatacatgcaaagtatctattagtatttcgacagttaataattcaacacattatgatggtaaagtaagagagaatttccatcttgatgtcggagagcgaaagccaattgtatactttatttacacaggtagggagtcagatgtttttaataaaaatcctgtgaatattgtgtctgaacttagtattttgatatctgatagtaataattctaaaactttatctggatatcatatctcctctttattgaagaaatcctcatctagtatggagtccgatttttcttttgaaataaatgatccatctatatgtccttaggattctgaaaataaaaaattctaatctcactactcgttggtattaatttcaataaaaggaagataaatcctccgatggacgacctgacccaacgctactatgaagccgaaatgcgctacctgcgtgaagcgggtaaagaatttgcgcaggcttaccccgaccgtgctgcgatgcttaatcttgataaacccggcgcacgcgatccctatgtggagcgcctgttcgagggcttcgcttttttaatgggccgcctgcgcgaaaagctggacgacgacctgcccgaactgaccgaggggctggtcagcctgctgtggccgcactacctgcgaaccatcccgtcgctttccgtggtcgaactgaccacggatcaccaacaaatgaagcaaagtgatacgctgaaagagtttcaggtgctatcccgtcccatcggcgaacgcagaacccgctgcgtctacagtgccacgcgtgatatcacgctgcatccgctggcgttgccggacgtgtcattgcaatatgaaccggacggacgctcggttatccgtctgcgctttgcgtgcggcccgctggttggtgactggtcgcagatcgatttatcccgcctgccgctctatctcaatgccgacagcccggtagcctgtgcgttgcaccgggctttaacgcttggcacgcagcagttctggctgcgtctgccggggcaggaacgccgtgtgctggacgcgcacttttccccgatgggttttgatgacgatgaccgactgtggccgaaaggtgagtcagcgttcagcggctaccagttgttgctggaatatttcaccttccgtgagaagtttatgtttgtggcgctgaacgggctggagaacgtcatctggccggaaaggataaccggctttgagattgacgtggtgctggcggaaaactggcctcatgatttgccgtttaataccgacaatctccgcctgcactgcgtgccggtcatcaacctgttcccgctcgaagccgatccgttacacctttcgccgctggaaaacgaatttctgctgcgcccgatgcgcattcaggacgggcataccgagatttattccgtcgacaacattatttcttcgcgccataccggcagtcaggcgtatgtccccttctccagctttcgtcaccggggcgggatgctgcgccacgatgcgccggaacgctattaccacacgcgggtaaagcgcggcccttccggcctgcatgacacctggctgattctgggcggcgatgcgtttgatactgaccggatgctggaggatgaaacgctctctttaaacctgaccggtactaacgggcagcttccccgtaaggctttacagagcacgctgctcgatacgccagttcatgcctcacagaacgtcctgcgggtgcgcaacctgtgcgctccgacgcagccctgctatccccctgcgcgtgaccgcttccactggcgggtgctcagtcaccttggttctaactttttatcgatgatggataacgccgaaattctgcgcggcacgctggcactgtacgactggaccgaaagcgagatgaaccgccgtcgtctggaggcgattgtcgacgttcagcacagcctgatacagcgttttgaaagaggctttctgctgcgtggcgtggatattcaggtgacgctggacagtaacggctttgccggagaaggtgatatcacgctgtttggtgaactgctgcaccgctttttcgcactgtatgccgatatccacttattcactcaactgaccttaattctgcaacccacaggaaagtgcctgcaatggacagagcatcacagccagcgcgtaccgggctgaccgaccggctggccccggatattgcgcgaatcaatttttaccgtttttgccagttgctggaacagagccagcagaacgcgccgctgggcagtaccgacagccccgccaccgatgcggtgcgctttcgtcctcatccaggtatgggctttccggtcagcgagttaaaaaacgttgaacgtgacgtgggcaatcccgacgcgccccccacggtgcgcaccacttttctcggcctgtacggcgtggattcgccgctgccaaccgcctatctggactacattacccagcgtcatgacggacatgacgcggtgatggcgtttctcgatatttttaaccatcgctttatcacccagtattaccgcatctggcgcaaatataactacccggcgtcgtttgaagcaggtgccgtggatgacatttcccgttgtctgctgggactcatcgggctgggtattcccggcagcgagaaccatatcgccacgccggtatcccgttttctggccctgctcagcgtgatgcgcctgccgacgcgcacggcggaaggcgtcacggcactggtagggctgcttgccccgctgaccaaagcgacggtggtgcctcacgatccgcagcctgtaattctcccggcccctgcgggtctgtcaaaaaattcacgcatcagcctgaaaacgcgaacgctgctggggcgtaccggtaccgacgtcaacagccagttgctgctgaaactgtataccgaagatgccgcagaagcacgtggctggctgcccggcgggcaactgcacagcgatttgctggtgctgctgcgcgtttatctgggctggcgctgtcaggcccgtctgcaactgacgctgcccgtcagcctgttgcctgctgccagactgggaaaacagcgtgtacagattagccgtaccggcatccttcgcgcctcctttgccgcgcccgcgaccggaacagtgacggtcagtctggggcgttatcagggattaatacccgctttttccattcgtaacagggagagtatgactcatgtttcctattcgttttaaacgtccggcgctgctctgtatggcgatgctgacggttgttctgagcggctgcgggctgattcagaaagtggtggatgaatcgaaaagcgtggcctcagccgttttctacaaacaaatcaaaatactgcatctcgatttcttctcccgcagcgccctgaatacggatgcggaagatacgccgctttccacgatggtgcatgtctggcaactgaaaacccgcgaagattttgacaaggcggattacgacaccctgtttatgcaggaagagaagacgctggagaaggacgtactggcaaaacacaccgtctgggtaaaaccggaaggcacggcatccctgaatgtgccgctggataaagagacgcagtttgtcgccattattgggcagttttatcaccctgatgaaaaaagcgacagctggcgtctggtgatcaaaagggacgaactggaggccgacaagccgcgctcgattgaactgatgagaagcgacctgcgactgctgcctctcaaggataaataaccgatggcgacaccttccttatatgaaatgctgacgttcagtttcagcggcgagttaccgctggaacaggtcagtgagcgggatcagcttatcctttccgtgatggacaatatgcaacgcattatcaactgtcgggcaggcacactggcgcatttgccggattacggtctgccggatctcagcctgatccatcagggtatggctgcgggtattcatagcctgatgcgccagattgaagaaacgctgctgcgttatgaaccacgcctgaatcagatacaggtggagttactgccccagccccgtccggggcatcttaattacctgatccacgcgcagcttcccgataccggctggatacgctttgatggcgtattttctccggaaggacgaattgttctgcgtcatctcaaacagcaggagcgggcgtactgatggcaagtaacgcgaattttatcagccagttcgtcatgggcggcgatccctgtacgtataaggaatccggtgaactgcaggctgaaatgagtaaactgactcacccggcccggccagacgtggactggcgccaggtggaaaaactcagcctcgcgctgttccggcaaaatggcgtggaactacagacgctggtctgttacgtactggcgataaccagacggcaggggctggcagggatggcagacggactcggttcactggatatactgctccagcgctgggctgacttctggccggtacaggtacattccagaatatcactgctcggctgggtcacagaaaaaatgcagcaggcactgagaacgctggatattcagtatcaggatctgccgcagatctaccgttgtgtacagcatctttccgccatcgaaaccacgctgcaacagtgtgaactgtggcatatgacgaaactggatctactggccgggcagtttcgcaataccgcattgcgtctggaacggctggcgcctcagggagcggaaaccactatcactccccctgaattaccccgccgggaaatgaatcaaccgaaaaagtcagaggaaagtccacagccggtttttgcaaccagatccgttcagcaaaacgataaggatgccagtccacccgttccatcccctgaaatctcccggcagcggacatggccgatatttatggccggaatggttgtgatggccggtctcggcggaacaggattatggggctggtcgcagcttaatcagccggacgcgctaatccagcgaatacaactgtctgtcatgccgttgccgctgtcgctggagagcggcgaactggcaaagctggatgtaaaggataaggcgctgctggctcaggacagaacaattgcggcaagtcagatgcaactggagcagttaaacaaattgcctgcccgctggccactggagcagggatatcgccagctacgccagcttgatgccctgtggccggataatcctcaggtcagggcgctgaacgcgcagtggcgcaaacagcgggagctgagcgccctgtctgctgaggcactgaatggctatgctcaggcgcagagccagctacagcgcctgtcggcgcagctggatgcactggatgaacgtaaggggagatatctgaccggttcggaactaaaaacggcggtgtacggcatccggcagtcgttaaaggagccgccgctggaagaactgcttcggcaactggaagagcaaaaacagaccggagaggtttcgccaacgctgttgacgcaaattgatacccggttaaatcagttgttgaatcgctatgtcattttactggatacgaaggtggaacaaagtcagtaaacatcgggggatttatgtaccaataagggatatgtgaccttgccattttttaaaggagtctctgtgtacaaaaaaagagaggaacaggccattcgatctactcgttgattcacatcagataatgagtgtatatttcggtagatagcttgggttcgggaacagtgaataccttaagtttcaaaagattggattaacctcttgactgtggcccccgcaaccaatttattagaatgctgacaaaccgcaatgtgttctacaaattgcggtttttttgtatttaaaatctttgttcgctgaactcacaacacgttttttatctcccttcctgcgaagtaatcaattatcgactgggcaacgtgtatcccggtttgctggtatgactcaacggtggcggccgcgatatgcggcgttgtaatgatatttttggcatgtagcagtgggctaaattgcgccaacggttcagagctaaacacatccagcgccgcaaacacatttcgttcttcaatcacctgaagtaaagcgccctcatccagcaactttccccttgcgacattgatgatcagagcaccattgcgcatcatcgacaaatatttatgactaatgaagttctccagcccagaagaaaaaggcaaaagaacaatgatgacatgcgactgcataaagatatcttcaattgatacaaactgaactccagctttgtcagcaacctgatagtcgggttgtttgtcaaaagctaaaagctcaacatcaaaaccggataaccttttcgccagagttttacctatattaccgtagccaaccaggccaatccgtttcccttgtaattcacagccatgcgactcaccccagtagccattttgcatcgcatgatagctgccagggatatttctcatgctcgcgaagataagtccaatgataaattccgcaaccgcatttgaattaatcccaaccgcattattgacaacaataccggattgctgtgccgcacgaagatcaatattgtctatccccgtcccgaatctcgatattattctcacaccaggcagcaatgatagcgtgtccgcctgataaccatcttttccggcgatgaccgcgcaaatagattctcgtaatgcagtggattctgatttaagcagatgctccatattattcttaataataagattaaaattattctctcttagcaacttgctggcggaaacacagcgtgctgaaaagctggggacggtgaccagaacatttttcatagcggacactcacttcaaagaacgccaccccaaaagatggcgtgaccggttactgtatttatattttgaaattatgaatttgctttaatgccgagtgcacctcctggatgatataagccgaaatcagcacgagtaaattttttcaattcagagagtgcaagcgccaccgcatcaccaacaaccagaacaacagtcgacgagcatgacggtgctaaacctaaattatccgcctcacttttgacggggatttcaacagataaatcacaacttatcgcaagcgatgagtgatgactgcgggtaaaagagatcaaataattacccatttttttcaaactaggcagtgtcgccaggatttccgccgtctcaccactgtttgaaataagaataacaacatcgtctttcgccaccattccaaggtcgccgtgtaccgcttccgtaccgtgaacaaaaaacgagggagttccggtactggcaaaagttgctgcgagttttctggcaataataccggacttaccaacaccaataaaaacaacttttccctgacaagattgtaatactttaattaaattagcgaattcagaaagtggggaatcaataacctcttctactgctttaagttcgttatgcataaaatgtttaatgagatagataagatccgtgttattcatttttattctccctgattaatatttttaattacactcacaagacgcgtaagccccatatataatttttctcgaccgcaggccaggttcagacgaaggtagccctccccctccgttccatagacatgccccgccataatgcccactttgccttcatgaattaatcgactgtagaattcatcaaaaggataaccaatagcagaacaatctatccaggaaaaatagcaaccatcagctggccttacgatcaattctggaatattttcattcagatactgctgggtgaattgaatgttagaggcaatatgtgcctttaatgactttaaccatccctcacattcgttataggcaataatagttgcaattatattcagtactgatggggagtttacaaaatcgcgatacctcgatatcgttctgaacttatgattaaaattatcgtcagttgaaatcatatacgatcctgttagagcaggaacattaaatgttttcgatatcgagttaaatactactactttttctttttttattttaagcgcggatgtaaagctacgattaaaaacaaaatcactatggatttcatctgaacataaccagacattatgccttgtacagcttgcagcgattttatgcagttcttcttccgaccagactgttcctgtcgggttatgaggattacataataacatcatctttgcgcttttaatcttaagatcaaaatcttgccagttgatagcgtagcccccctcattttttataatcaaagaggctgtcagaatatttcgctcgctatgtttaattacatcaaaaaatgaattatagacaggtgtaaaaacgagaatattatcaccatgcgatgtcaataactctattgcttttgcaatagagtacatcacactggggctataggttatccattcaggtttaatatctgtttgatattgttgataataccagtttactatcgcattcagatattcaccatgttgccaacgactgtaccctaaaatcgggtgttccaggcgtttttttaatgctctggtgatagcgtctggtatcggaagatccatatctgaaatagagaatggtagtacatcttttacaccaaatctgtcctcgcaaaagtcccattgggtacaatatgttcctttgcgggaaacaggagtattaaaaacatccatcagtatatccccatatagttatccatatcccgacgcagggcgatgactttagtgccgataatgacttgtagggtattttgatcaagtttaacaaccgcaatcccgccagctctttttattgcagcctcgtcaatcaatcccatatctgcgattgttaaacgtaaacgagttacgcaattatccagtgacttaatattctctttaccaccaagtgccttaaccatctgctccgccgcttgcagctctgatttatcaggagttgggatatccgctatagccgtatcttcgtgagcgttcagcgtgacaggactggactcttcacggcctacggtcatcaggttaaatttaagaatggtccaacggaacacaaagtaataaatgaagaaataggccacttcgacacataccgcgatcggccaacctgttcttgtgccacgcaatacgccaaagctaataaattgaatcagatcaccagtaaatcccatcttcacgcccatatatggcagaaccatgttagcgaatccattcataaaggcatggaagacaaacagcagtggactgacaaataagaacagaaactcaatcggttcgctgacgccgccaataatcaccgtaagcaccccggaaataagcaatgctttgatagcctttctgttttgagcatgagcagtgcgatacatcgccagcgcggcaccagccagaccatactgaatcatcagtttgccctgctccattttccccgccaaatccagcggaatgaccgcattctctttgacgtatgccataaacatgttcagggtgccgtaatattcttcaccgccaatcacagccgaaccgccgattggcgtaaagcggaacactgacgtcaccagatggtttaagccaaaaggaatcgtcacacgttcggcaactgcatagaagaaataaccaacaggaccggaagttgatatccagtggccaatgagcatgaagagattgaaaaatggcggccagataaaaggaatgatcagaccaaatccactcatcacaatcagtgtaatgataggcaccagacgtgggccgctataaaaacctaatgattctggaatgcgtaaattaacgatctttttatacatgctggcgactaataacccagcaacaattccccccaacacgctggtattgtaggactggatccccagaatgatggtttgcccatgtgtcgacatttggtcagcaacgaccaataagtcgtgctgtttaagataaaagttcgttcccagatgcatcgccataaaaccaattaagccagaaaaagcaccataggctttatcctctttatcttttaataatcctaagggaatcgctatcgcaaacaatacaggtaaattaacaaaggcaaacaaaccaagactaacaatgaaatcaagtatggttttaattattggaatagccagaaatggaattaactttgccatatcatcactggctaaaccacttcccagccctagcatcatgccacatacacttagcagagcaatgggatacataaatgccttccccaggctctgaaaaaaactccaggctttcttttgtttcatgtgggttatctcatataaatgttatatataattagtccattaatactttggtacgaatagagagatatagtttttcttctaaaattaattcatatttaaaagtggcatacagataccgttcaatttcatgaattgcgcgctgtaacaggatgtccttttcaagaaactgttcatagatatcaccaatatctttctgttttattttttcattgcataacacgcgacttgaaaaatatttaaggtgcatcataaatctggaatagttaaatgaacttctgtccacctttctgttataaacaacttcaataagccccgtgattatttgcgacaactcaataatccgtactgattcataatcaactgaattttcataattatttaaaatatgcaatgctataaaaccaatctcatcatcaggaagttgaacgctgaattgctcattaatgatagttaatgcatcgcgacttatcgcatactctgctttgtacaacgctttgatttcatcaaggaaaacattattaatttgtatacctgaaacgactcgggatattgcattcgaaatgtgatccgcaagaatcaatagtagcgatggattgagatttttttcgagatttttctccgcatattgcactattttttcggcaacaaacacatactcaatatctacatgttcaatcaatttataaagtttgtttttttgttcatttctgacataaaaaatccggttagccggatgctcagggaccgacattccatattttttgttgtaaccgacgccaggcccagaaatgataacctcctgtccattcatcgatgcctgtacacaattattgttcatgactttttcgatgatcattccatggctccaaaaaaaaaggcaaggcacgtcagaagtaataactacttcaaacattgccttgcctgatttaacagttacaagatgattaactaatgcgtatacattacacggaattgtgcttaattaaagagatggtcggcttatttttcaagccgacattcaaatatccgacatcagtcacaaaaccagcgtctaatattcaggtaaatgttatttattcaacgaaatataaattcattgaataaataaaaacattatccccttctcgccagcgtcgccccatcggcaaaatacgctttaattcccgcaagaatagactccgcaacttcctgctggaaagtcgccgttttcagtttacgctcttcctcaacgttactgataaacgccgtttcgaccagaatggagggaatatctggtgcctttagtacggcaaacccggcctgttcaacttgatttttatgcagcttgttgattttaccgagcttattcagcaccgctttaccaaacttaaggctgtcggcaatggtcagcgactgcaccatatcgaacatggtgtggtcgacatagcggtcaccgcttttgcttacgccaccaatcaagtccgaggcgttctgggtttgtgccagatattttgccgcagtactggttgcgcctttggttgagagcgcaaacaccgatgaaccgctcggctggcgactggtaaaggcgtcggcatggatagaaacaaacaagtcagcgcgctgtttctgggcttttgctacgcgcacttgcaacggaatgaagatgtcttcattgcgcgtcatgtacaccttcatattgccctctttctcgatcagagagcgcagacggcgagctatttgcaataccacgtctttttcgcgcgttttgtatttccccaccgcaccggagtcttcgccaccgtggccagggtcaagcataatgacaatcggacgatcccgcccagctttacccggttgtggaccactttgtgctggcggcacctgcttttcgaggtcgcctttgttgtaatcctccagcagcgccagcagcgggtcctgcatatcctgtgcattggccggatagaggtccatcaccagacgctctttaaacccggcgaccggcgcaagggcaaacagctgcggttttacgttttgctttaattcaaaaaccatacgtacggtttgcgggtcaaattgcccgacgcgcgccgacttgatgaacgggtcgtcagcgcggatttgcgcagccatccccttgagcaccgagttcaggtttacatcttcgatatccaccaccacgcgttcaggattactcaacgcgaactgcttatatttcagctgacgatttgattctaccgtcacgcgggtgtagctggacgcaggccagacgcgcaccgccacgacctggctgaccgcagccaggctgacctgacttacgctcaatagccacatggcacccgcgccttgcagtaaacgacgacggctgattgcagtgttggatcctgacatgcctctcccgagcaaaagaaatctaagctgtgtaacaagtaaacgaccaatttgaccggaaactttagcgaaagacgcataatctgtcatctataaaacggtaaacattctttttatattcacggtattactgataaaaaactcgctcccgcataaaatttacacttgcaccctgcgaaaaaacagaataaaaatacaataatttcgaataataatgcaaagaggtataccgtggtaaaggaacgtaaaaccgagctggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcacatcaccacgaaccgctgtatcacaagaatatacgtgtgaccgacgccaaaacactggaactggtgaagcaggcagcgggaacattgcaactggatattactgctcgcctgtcgatgagtctcaataacacaccgctgcagggcgcgcatatcaacgtcgtcagtggtaattttattattgcccagccgctgggcgtcgatgacggcgtggattactgtcatagcgggcgtatccggcggattgatgaagacgcgatccatcgtcaactggacagcggtgcaatagtgctaatggggccggtcgctgtttcggtcactggcgagagctttaatctgacctcggaagagattgccactcaactggccatcaaactgaaagctgaaaaaatgattggtttttgctcttcccagggcgtcactaatgacgacggtgatattgtctccgaacttttccctaacgaagcgcaagcacgggtagaagcccaggaaaagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatattggcggtattctggagttgattcgcccgctggagcaacaaggtattctggtacgccgttctcgcgagcagctggagatggaaatcgacaaattcaccattattcagcgcgataacacgactattgcctgcgccgcgctctatccgttcccggaagagaagattggggaaatggcctgtgtggcagttcacccggattaccgcagttcatcacggggcgaggttctgctggaacgcattgccgctcaggcgaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttggggtaagcgatggaaatcgccggatgcgacatgcataacattcataggcatgataagacccacatgcgtcgcatcaggcaattacgtttatccccgtgaactaaacaacgccgccagaccactgcgccgctcggtgcgcgtggcaattgccgcacttaaaatgcgctcatcggcatacagcgacagacggcgacgcgcgcgggtcaccgcggtgtaaaccagctctcgcgttactaccggcgtgcgttgactcggtaaaatcaacgccgcatggtcgaactccgatccctgcgatttatgtaccgtcatcgcccacgtcgtttcgtgctctggcaagcgactcggttgcacagacttaatattgccgtccggcatcgcaaaccagacgcgcgtcccctgcccgcgatccagcgcaataccaatatcgccattaaacaacccaagcgcgctgtcattacgggcaatcatcaccggtcgaccttcgtaccaacgagagtgcggatgacgatgaattttgcgcttctgttgcataaactgctcaattcgctcattcagtccagccacgccaaacggcccttcccgcagggcgcacaaaagctggtactcattgaacgcctgaatgattaaatccggctcggcacgcgcttgcagcagatccagataacgtccgtaacccgcaagagcttcctcaagcatcgcaatataatcttcgccgctctgtaaaagtcgtttttcgatatcagtaaaatcctgctgaaaaacggttttcactgccgttttatcaccacggttaatcgccgcagctaactgaccaatgccagaatcgctgccgaaacgatagcttttttgcagcaggcagaggctgtcgcgcaaagatgccgcttctgtgccagttcctgccggaacgtggcttcccgtcaggcggctcaactgcccggcacgctcggcggtaaagccggcgttggcataagcgcagatatcgcccaacactgccccagcctcaaccgaggccagttgatcacgatcgccgagaaagatcactcgcgcatgatcgggcaaggcgtcgatcagtctcgacatcataggcagatcgatcattgacgcttcatctaccaccagcacatcaagatgcagcgggttaccggcatgatgacgtaaacgctggctacccggctgcgcacccagcaatcggtgcaaagtgctggcatcttccggaatgcgtttcttttgttcatcggtcagcggtaattgtcgcaaagccttgccaagagattcggttaagcgcgcggcagctttacccgttggtgcagccagacggatacggcagcgttctccgtcggccatttgaattaaggctgccagcaacttcgctacggtggtcgttttaccggtgccaggaccgccggaaatcaccgaaatccgccgcgtcagcgccactgccgccgcaactttttgccagttaatttcatcgcttactggaaaaagtttgtccagggtttgcgccagtagagcttcatcaacctcaatggcatgattcacttcgttgaaaaagcgtgccactgtgcgctcgttacaccacatgcgattcaaataaagacgatcgccacagaggatcatcggcgttggttcatctccccggctgaccgcttgtgaagccagcaagcattcttcccaattttgtagctcaccgatttcactgacacaggtcgccaacagcggatgcgatgcctcgttattttccagtcgtgaaagcggcaaacaaacgtgtccctctccggcatcatgacttaatagtgccgccgcgagggtgacggcaggatgttcatctcccgccacggtcagggcaaactgcacgtccagcgggcgtatctgtttgtgctccacagcttccagtaattgcttttgcaatttcattacgcctcctccagggtcataccggcaaacatctcatccatcaggtcaatcaacccggcgttgggtcgggtcgcgtagatcccttgttgcggatgttctttatcaacgccgcgcaggaacagataaataacgccgccaaagtggcgctcatagtcgtaatcagcaatacgatggcgcagataacggtgcagcgccagggtataaagctgatattgcagatcatagcggtgtgcctgcattgccgctgccatagcctgttgggtgtaagccgaactgtcttcacccaaccagttggatttatagtcgagcaggtaataacgcccttcgtggcggaacaccaggtcaataaagccttttaacattccacgtacctgcatgaactccagcggcgggcagccagcggatagcgggtcaaactggcgaattagtgcatcaagctggctggcgataagcggttcactaatcggcaggtaaaactccatctccacctgtttatcgcgatcggaaagctgattcaggctaacacccgtttcattgagaggtgcctggaggacagccgtgatccactcagtcaacaccggttcccactgcggttcaaagccgccgagctccagtttttcctgtacccagttcgggtcaaccggctgggtaaaatcgaggtcttcaaacaaactgtgcaagaatgtccccggtgacgcaccgcgcgggaactgatgcggtgttaacgtcggttcttcaacgacgctgaccacgcctgcggcatcaacatccaaccgtggcatcagatcctgagcgataccgtgaccacgctgctgcaaaccggagtagctggtgacacgccagttatcgccgggcaatcgttgtagcgtcctcgcattcagttctgcagttaatgcatcattaacctgccagggctggttatcaccagtttgtgccgtttgccaggcaatatcatcatcgcataacgcttcaatacaggtgcgaagccctgccgcatcttgcggttcccctttttgcagcaaacgcccgagcgcactttggtggacgtcggtatcaccttttttatcgccacgacggcgcaccagcggtgcaacgccgagactgcaatgccaaaccgaacgcgtcagcgccacgtaaagcaaacgcagatcttccgccagacgttcggcctccgcgaggtcgacgctttctggcgcagcattaagatccagaacagcctcaaacgagtggcgatcgtgataaaacgcctgatcctggacgcggaaattggtgataaacggcagccagaccaatggatattccagccctttcgatttgtggatcgtgacaatctgcacgagatgtttatcactttcgagacgcatttgttggctggaggcattactgtctggctcgaggatatgttgcgataaccagcgtaccagcgcatgttcactttccagctgcgtgccggcttcttgtagcaattcgctgatatgcaagatatcggtaagacgccgctcaccgcctgctgttgccagcaagttttctgcaatgttacgcgccgacatcagcgcccgcagcatcggcataacgccacgtttgcgccagatttgccgataaccatcgaactcttcgactaccgcatcccacgcatgttcgtcattattcagcgtttcaatatccagcgcattcagccccatcattgacgttgccagcgcactgcgcagggtgttctcacgttcgggtgtcatcaccgcctgcaacagccaaagcatctcctgtgcttccagagtttcaaaaacactgtcgcggttcgaaaggtaaacggaagggatttccagcaacgttaaggcatcgcgcacctgggcggcctcctggcggctgcgcaccagcacactgatgtccgaagcacgtaccggacgtgcatcatcgccgttcatcagcaacgcttccccgcgctgcccagcctgtaaccagtcgcggatttgcgcagcacatacctgcgccatggtactttgatagtcgccaacgccgcagctttcgccttccatcagccacattttcatcgcaggctgcgtttcacctttaaacacaaaacgtaacgcctgatttttcccggctgatttcacaggaataaacggtatttcgcgaaacatgaacgcgtcatcagtctggctgaaaagcttgttcacactattcaccattcccggtgcggaacgccagttggtgtctaaagtgtagtgggcgtgaacttcgctacgcgccttcatataagtgaagatatccgcaccccggaatgcatatatggcctgcttcgggtcgccaatcagcaacaatgcggtttccggctgatggtgccagatacggcgaaaaattcggtactgctgggggtcggtatcctgaaattcatcgatcattgccaccgggaatcgcgtacggatcgccgctgccaacacctcgccgctttcgctacgcagcgcggaatcgagccgacttaacatgtcatcaaaacccaattcgccacggcggcgtttttcacgcgctactgtttcgcggatctcagccaatgcgcgagtgatcaccagatcgcggatcgacaatggttctgcaagcagttgatcgatcgcctcaaacagtggatgtcgcggggtttcccccccggctttcgtgcgatcttctaagaaacgctgagagaatttttccagcgactctggcaactgataactgttggtctcttcttctgcccaggcgctgatcttgtcgatccatttagcctgattgctacggttaaacttgcgtcgatcaataccagaagattcgatcagcgcatccagttcacccactgcgtcgcgccactgctgttttaccgtatcaatacacgccacaatttgcgcgtggcgggaagccagcgtttcatcatcgggcggcggtgctttgataaccggtgcttcgccttgcagataacgattaatatcgcgcagcaacgcctgcggccctttccaggtttcaaagaccacctgggcaatttcacgcgtcagcgggtagcagtggcgacgccagaaatcggcgcaggcctggtagcgtagcagagactcatcttcaatcagctgctgctcaaacagcatgccggattcaaaggcattcaggttgagcatgcgctggcaaaaaccgtgaatagtaaagactgccgcttcatccatctgccgttcggctaacaacaaccactgcgcggcttgcgctttatcgtcgatctcttccagcagacgtgcatacagcggattgtcagtggtttcacgcaggcaggcgatacgcaactcgtgaatattgctacggatacgaccgcgcaattctgccgtggcagcctcggtaaaggtgaccaccagcagttcttcaacggtcagcgggcggggaaaggcggcggaaccgcctagcccaagtaacaggcgcaaatagagcgctgcaatcgtaaaggttttgcctgtgccggcagaggcttcaatcaggcgctcaccctgtaagggcaagcgcaaaggatctagtgtctcggcgacatcactcattcttttcactcatcaggggcattgtttgctgcaacgcgctgacgttctcccacactttccagccttcaggatgcacatattcggctttcccgttctggctgccggaaatctgcgacagaatagccataccttgcggctcgaccaccgcctgatggaagaaatcagcaagtttttgcggcgtcagcagttttatctgggccacgattttatcacgcgaatcgaagcgcatattgccgcgatcgaaatctttacttaacttcgatgcttcttcgccgagcgtttgcggtgcctgcagcatctgggttattaccgcctgctggatttgcgcaaactcttctggcttcatcgtccgcaattttgcctctgcggttgggaaaaacgccttgtaacgctcccacaagaatgaaggctgtttatcattgctttgcaaaaggaagcccatgccccactgacgccccacgctcattggaaacgcaaacacggcatagcccaactgttcttcggtacgcaactgattgtagaaccacggctgtacgatctgccccaacagagagctataggctgagctggtgtattcatcgtagccagtcggtacaaatatcgctgccagtgcggagtcggtgctgttaccagctttttcaaagatgacggattgttttttatcgaccacgacatctttgttacgacaccactctgaaccatcagcgcccaactgtttttgcacatggcgtgccagcgttgttgcctgggcttcagtcatgttgccgataaccataaactctggtctagcccctgattttaaggcgtcgcgataggccagcacctctttcaacgtaatggagggcaaaattttgcgccgttcatctcgcgagaagtacggcacttgcgagagcatctgcgcgggcataatcgcctgctcaaacgctttgcccttttctgcggaatccatcatctggttataccaggacttcgcctgctcaagctgatcttccgtagcggtatagctaaagtagccctccagcagagcctggaacagctgcggcaggcgctgagtgtaaccattggcattaaccataaggccgttgttagcattggtggaaaaacttatgccaccaaccgacgcctggttgcttaactgatcaagcgccagccctgcgagataatcattgagcgcaaacatcacctgattgcgggcgctgtccatggctttcggattacgcaaaatcaggctgacatcagctttgggctcactggcaaaataacggcttggcgcatacaccacgcgcagattcgactcatcaacaatcaactctggatggtcgtatttcttctctgacttaatcagcgagaaatcgtcaggaatataggggttaagctccggtaaggagagcgcaatattggcggcttttttctgccagtccgcgaaagtttgttcgctgattttatcgacttgatacggcgcatcgacaaaataagccgttttattgtgcggctctttcgggctgatataccagatacgcgcattctgcggcgtcatcatcgccagacgttcttttactgctttagcatcgtaccgatcggcaatattgactgcatccagtgtatgctcaacaggaacgcgaatcatggtatcagccagccattcgacgtaatccatatcacgggtgattgacggataacggaagtcgatatccagcacattcgccagttcatcgaagtattgtttatcgatccctttttcacgtaacagattgagatagctaaaaatggccgccacaacctgatcgcgattcgccagacctttatcggttaaagacgcagagatcgctaatacgccgctgttgccgttgacgataggatcggaattggcgctaataccctcaactaatccctgcttttgcagccagtcagaaagtgtaccagggctgcgattaccaatcagataggtaatcaattcatccgttttactacggaacttcgctgaattgttatcgatgcgaaactcaacgcgcagaactttacgcggcaacgccgggacgtaatgaatgataatgcccttttgcgcgtcggtgactaccggcacggtgatttccggttttttgctctctttgttcggcacgcgaccaaaggtgtccgccgccattttcgccaactccggcaacggtttattgctgtaaataaccgccttcatcagattggcggaatagtacttctcgtggaaatctttcagcgcctgctgtaccggattacctggtttgtcgcttaaagtttcgaggttaccaccagaaaactttgaaccggggtgtgccgggttaatggtttctgcgctgacctgtgccatgcgcatcccgtcacgcgtacgcgccatggttaattcggcattcactgcattacgctcacgttcggcgtatttcttgtcgagcaagggttctgcaatagcatcggccaggcggtctaccgcaccgggtaaggcatcgttctcaacttccagatagaaagccgtgcgatacggtgccgtgctggcattgtgactgccgccgtgcattttgagatattcggccagactgtcagcctgcgggtactttttcgaccccatcagactcatatgttcaaggtaatgtgccagcccctggtacgcctcaggatcttccagcgacccaacgggcaccaccagcgccgagagcgatttaactgcctgcggatcagaaaccagtaagaccaccataccgttatccagacgtatagcctgatactggcggttatctttatcacttttacggatggtttcctgaatcggctgccatcccgtttctgcctgacttaagggtgcccagagggcaacaaacaacaataatgctttgaaccagatgctgcggggcattcacggacctcataatcaactttattttctggccagattcaacacgttaacgcaaatcatctgccagaatttaatcttgtgctgcacgagtcagcctatgtctatataaccatcagtccgtgactggtgcgcatcataaagtaagcggatagattgcgcaatttttatacaatactcatgactgattaaagcgaaacagcggtaacaggaaacgttgcgactgttcaacgatagcctccattgtctctggtgttaattgccgccagagccgttgataccagatatcatcaccttcgccacgcaccatcatgttgccttcgtaagcctgaaggaatttcgtacgggctttttgcaacgtggaatcgtcatccagcatggcatcgttttgcgcgtcataacaggtttttagccacgcgccgccactttcaggtaacaccagcaatggcgcggacattccttcacgatacccttcaatcagctgtgagaggtaatgtaaagcctgttcggctgcaagcggcggaaaacgccactcgccgtctttgcgtagaaaaaggcgactttcaccattaccaccgctggcacagtagacaaggtgttccagccaaagttgcattccctgcgccacacttaataaagagggacgccagcgcaacaggccatccggctgcacctgcggcaaccagccagttatctgcacaccgttgcaggcgagatcaatctccatactctgccctggctggcgacaggcaatgactctgtcggcaagttgctgcatctcctgacactgcgtttcccagaaaatttcaccaaaggcaccatacggcaaatcacctgccgcccggaatcggcggaacaagcgttcggcatcatcctgctcaaccagtacatttaataactgctggttgatttgataacgactaagcccttcaagaataaaaggttcggagtcggggatttcgctgtcttcggtacggaagttcacctgcaaacgcatctggaaaaatgcccgcaccggatgtgcccagaatcgttgtagcgtttccagcggcacggtttccggtaaggtaaatggcagcggctgaacaaattcagaatgtgctttaccagcctggctggccgcaggtagccattcacgagcatagctttgtcgttcgcctggctggtagttttgtggatcaaacggcattcgggtatggaggcaagtaagatgcgcttttacccttgcctcgctttcatcacagttgagcgcttcatcgcccggtagataatggctttgcccgatgtagtcaatcagttcctgcaccagtaccgacgggaaacgttcactgttatcctgaatggaacgcccgatatagctgatatagagtttttgctgcgcggaaattaacgcttccaggaacagatagcggtcgtcatcgcgacggctacggtcgccacgcttcggtttctggctcatcagatcaaagcccaatggcgcaagctgacgtggataaacgccgtcgttcattcccagcaggcaaaccactttgaacggaattgaacgcattggcatcagagtacaaatgttaaccggtccggcgagaaaacgctggctgatacgttcttgatccaggcgcagtgccagttcatcacgcaatagtgacagcggcaccgcgtcgccatactgcgcacctaaaccttcggcgataatcgcctgccattgttgttcgatcagcgtcatcgccgcttcggtttccgcatccggcaggaaaaaggcgttgagcatatcgcgacaaaccggcaaccactcttccagcggacgctcctgcgccagcccgcgacgccagatatttagctgcattagcagtgaagccagatgccccaccagttctgcaattaagccgctcgattcatcataaggtagaaccgattgccactcgccctgcgcgctctccatcgcgtagcccagcaacatgcgcgtcaggccaaaccgccaggtgtgttgaccggtagcgggaagttccagctcgcgaacgttgtcgtcatctatcccccaacgaattccggattcgttgacccactgacgtaaataacgcagcccttcttcggtgatgtcaaaccgcgctgccagcaccggcacatccagtaatgccagcacgtcttccgacacaaagcggctgtctggcagcgataacaggctgataaacgcttcaagtacaggatgcgactgccgcgcccgacggtcggaaatggcgtaaggcaggtaacgatccgcaggtgcgctaccaaacacagcctgaataaacggactgtagctgtcgatatcagccaccatcacgatgatgtcgcgcggagtaagtgtcgggtcttcctccagcatcgccagcaggcgatcgtgtaaaacttcaacttcacgctgcgggctatggcaaacgtggaaggtgatactgctatccagtggatcaagcgggcgtttgttatcgctacgggaaaactcttcgatgttcacaccagcaacggcgcggttttccagttccagaatgtcagactgaatattatgcagcaggttatctggcgtcacatcgacaaaagcgtccagctcctggctgctctccaggtcagaaaggagataaatgtagtcgcgcccaagcttgccccatgaagccagcagcgggttgccgacatcctgttcaccatcgctgttaaagagctgcccggcattttcgctgtcgcgaaatagcggtaattcgcgatcttcaaaactgtgtcggcgctggcgagtcagtagtttcgccagataagctggatctttaatgtcgccccagtaataacggcaggggttggtaaacaggagatggatttcaatatgtttacccagcgcctgtagcgcctggagataaacaggcggtaacgcggaaataccgcatataaagacgcgcgaaggtaaccccggcgggcaggtcgtcgcggactccagcgtttcgataaagcgctgatagagattggcgcggtgccagcgcggttgcccaagttcgtcggtatattccaccaacgccttccacaacggcgcttgccaggcctgtgcttctcccaacccttctaccagatgtcctgtttcccactgtgccagccagtccggacgatagaccagatactggtcaaacaggtccgccgcttttgaagaaagctggaacagttttcgcttgtcactatcgtcagtcagataatgccgcaacagggtaaagtcttcgcgctccaacagttgcggcagcagagtcatcagtttccagctcatgctctgtttgttaaaggcgctctctttggggatctccggtaatacccggacgaacatatcccagataaagctcgctggcagcggaaaatcaatgtttgccgcaataccaaacttttgcgacagggtcatttgcagccactgtgccataccagtactttgcaccagaatcatctctggttcgaaaggatcgtccagtcgttcgcgttcgacaataaactccatcaacgcttccagcacgtccagacgattggaatggtagacccttaacatagcggctcctgactactgacgattcgggcaatgcaggcgggtcatctcgccttctctgcccccgggtgaaactagcgtaacgctgatgctgacacatcccgcctgcgatgtctgcattcggttgacctgccagttagcaggtggcgaaatcgcgcgcagttgcgtttgctgccagccatgccgccagagctgttggtactggtttctgctggcaagactgttcattaatgttcgctggaaacccgataacgcagtgacaatcatcaccatcaacaccatcgccaacattacctccggcagactaaagccttgttgattcctcagggaagctgacataacgccctctctttcagcggacaaaaatcgctccagccgcgtggcgaaaaaacaatgtttccatcgatgacttcgcctgttcgccacaacgaaacgccttcataaccagcaatcaataaggcttcattatctgccagtaaacgcagacaaacccgggcaccggtggcagcatacagtaagcactgaactgcgggcagcgtctgccaggagtgcatttttccccactccagcgccgactgaacgatggcctggcggcgcaatgactgactttccatgctcacgcgagaagcaaaactgcgatcctgctgactcattccttgcaatagcaagctacccaaaatcagcagcatcaggaccagagccagtgacgaaacacccttttcgcggttcacaggttggatcctgtcacgctatagctggcatccaccacggtttgcggatcagccttgctggcagcgtgcatattaaccgtcaacaccggcgagaagtcgctgacatcctgacgtacgacctgaaaagtgtcgataatgatggcatccggattagtgactttatcccagcccttaccttcacaggatgtcgcaccgcgtagcgtttccagcacatgctccttcagacgaaatccaatctggtcggactcttttaccggttcgcgatcccagataccattactgttcgcatcccactgcacaatgacacagtcaccctgtccgacaatttccagcccttcgcccgtacagctgccatggcaataacccgccctctggagatgcttcgcgacggtaaatacccgcagccagatttcatcttccagcgccagcttacgggtgttcgttaaactttcacgctgtaacgcaggcagaaagcgtgcagcccccagcaacaatacgctactgatcgccatagcaatcaacacttccagcagagaaaaaccttgctcttttacaggcatccttctgtttctccttgctgacaaagccggagtcttccccacggcgaaaccaccagccaccactcgcccgttgagtttttgaagcgaatatgcccggcccatgcggtattgcgcaggccaaagaaagcaagcgaaggtgtcaggtcgctcatttcgacttcgggccagcgcggcacaaagaccaatggtgaactgccatgacaggtattcgccccagcaacggaactcacaaggcaccataacgtcccctccctgataagactgatactgtggtcgcggttatgccagttggcatcttcacgtaaatagagcaaatagtcccgcgcctggctggcggtttgccaaagccgttgcgactgctgccagtattgccagccatagagcccacttgcgcttagcatgaccagaatcagcatcgcgaccagcgtttcaatcagcgtataaccacgttgtgttttcatgccggcagtatggagcgaggagaaaaaaagacgagggccagtttctatttcttcggcgcatcttccggactatttacgccgttgcaggacgttgcaaaatttcgggaaggtgtctcgaagaatttaacggagggcaaaaaaaaccgacgcacactggcgtcggctctggcaggatgtttcgtaattagatagccaccggcgctttaatgcccggatgtggatcgtatccttcaatctcaaagtcttcgaaacggtagtcgaagatggattcgggtttacgtttgataatcaacttcggcagcggacgcggttcgcggcttaattgcagatgagtttgatccatatggttgctgtagagatgcgtgtcgccaccggtccagacaaaatcacccacttccagatcgcactgctgcgccatcatatgcaccagtaacgcgtagctggcaatgttgaacggcaggccgaggaagacgtcacaggagcgctgataaagctggcaagagagtttgccgtctgccacatagaactggaagaatgcatggcacggtgccagcgccattttatccagttcgcctacgttccacgctgaaacaataatgcgacgggaatccgggtcgtttttcagctggttcagtacagtagtgatctggtcaatatgacgaccatccggcgttggccaggcgcgccactgtttaccatacactggcccgaggtcgccgttttcatcggcccattcgtcccagatggtgacattgttttcgtgtagataagcaatgttagtgtcgccctgcaggaaccacagcagttcgtggatgatggaacgcaggtggcaacgtttagttgtcaccagcgggaatccatcctgcaggttaaaacgcatctgatgaccaaaaatggaaagcgttccggttccggtacggtcgtttttctgtgtgccttcgtcgagcactttttgcatcagttctaaatactgtttcatggttcctcaggaaacgtgttgctgtgggctgcgacgatatgcccagaccatcatgatcacacccgcgacaatcatcgggatggaaagaatttgccccatgctgatgtactgcacccaggcaccagtaaactgcgcgtcgggctggcggaaaaactcaacaatgatgcgaaacgcgccgtaaccaatcaggaacaagcctgagacagctcccattgggcgcggtttacgaatatacaggttgaggataataaacagcaccacaccttccagcagcagctcgtaaagctgtgatgggtggcgcggcagcacaccgtaagtgtcgaaaatggattgccactgcgggttggtttgcagcagcaaaatatcttctgtacgggagccagggaacagcatggcaaacgggaagttcgggtcaacgcggccccacaattcaccgttaataaagttgcccaggcgcccagcaccaagaccaaacggaatgagtggggcaataaaatcagagacctggaagaaggaacgtttagtacggcgggcgaagataatcatcaccacgataacgccaatcaggcctccgtggaaggacatgccgccgtcccagacacggaaaagatacagcggatcggccataaactgcgggaaattgtagaacagaacataaccaatacgtccaccgaggaagacgccgaggaagcccgcatagagtaagttttcaacttcatttttggtccagccactgcccggacgattcgcccgtcgtgttgccagccacattgcaaaaatgaaacccaccagatacatcaggccgtaccagtgaagcgccacgggtcctattgagaaaatgaccggatcaaactccggaaaatgcagatagctactggtcatctgtcaccacaagttcttgttatttcgctgaaagagaacagcgattgaaatgcgcgccgcaggtttcaggcgctccaaaggtgcgaataatagcacaaggggacctggctggttgccggataccgttaaaagatatgtatatgatccgcgctataaccccccgcgaatcagcccgcccatgccgcgacgctccataaaggcagcaacctgatggcgaacttcggtcgccagttgcgcttccagactacgctgcgcaagattttctgcttcagcaaaatcaatgcgccgcagcaggtattttacgcgcgctacagaacgtccgttcatagacagatggcgatacccaagcccaatgaggattgccacgcacatgggatcgcccgccatttcaccgcacaaacggagatcgattccatgtatttccgcttcccgggcgatcatcgccagagctcgtaacattgcaggatgaagactgtcataaatgttcgccacccgggtattgttgcgatcaacggccaggatgtattgcgtcagatcgttggtgccaacagagatgaaatcgacccgctttgccagatgcggcagcataaataccattgacggcacttccagcatgatgccgatacgtggtttgggaatttcgtaaccgatcatctcctcgacttcacgtccggcacgttcaatcaggcggcgtgcttcgtcaacttcatcgaggcttgtgaccatcggcaacagaatattcaggttgcccgtagcggcattagcacgcagcatcgcccgcacctggatcaagaagatctccggctgatcgagcgtaatgcgaatcccacgccaacccaggcatggattctcttcgctgatcggcatgtaaggcagctgcttatctgctccgacatccagcgtacgcaaggtgacgggtttatcattaaacatttgcagcatcccctgatactgcgccacctgttcttcttccgacggaaaaccactttgcagcatgaatgggatttcagtgcgataaagtcctatgccatcaatacggctgcccagtttttcttcatgttccgggcttaaaccggcattgagcatgactttaatgcgttcgccgctttttaactgggcgggtaaattgacgtcatcttccgccagacggctaagctcgatctcttcactaattagccgctgatattcttgcagcagtaccggttccggatcgaccagcaattcaccgcgataaccatcgacgatcagcgtccgacgatgcagtaccgaaggctgaatatccgcgcccatcacggtaggtatccccagcgcacgtaccatgatcgcagcatgggagttggcagcgccatcgcgcacgacaacaccgactaagcgatcctggggcagctcagcaagcgttgtcgctgacagttcatctgccaccagaatgaaacgttccggccaggcgttcggcccttgattagcgtcatcaagatgaaacagcaatcgctgacccagcgcacgtaaatcgccagcccgctctttgagatagttatcgcttagcgcggcaaactgttcggcaaatttttcaatgaccgtttttaccgcccactctgccaccgagcctttatcaacctcggcaaacaattcgcgacgcagccgggtatccgaaagcaggtgtgagtaaagatcgaaaatagccgccgtttctttttgtgcaccggcagcaaagcgtttgctatagcggcgaaactcgttagccgcctcttccaacgccccggtcagtcgttcgcgttccagagccggatccagcgttgatgcctgatacacctgttccattaaaggtaacgtggcatcctgccagccttcggcaatcgccacaccaggtgctgccggtaatgcacggattcgcgtctggcgatattgcccaaacaaggcagtcaactgcgactgagaaagaatagctgccatctgggtggcaagcgtcaccaggaaggattcttcactttcgtcatactggcgcaactctcgttgctgtaccaccagtacaccaagcaactggcgacgttgaataattggtacgcctaaaaacgcgcggaaacgttcttcttttacggaggggatgtatttgaagctggggtgcttttgcgcatctgcaaggtttatcggttccgccagcctgccaaccaggccgacgatcccttcatcaaacgcgagcgttacagtgcgaccgcgtggttttttcagtccccgggtcgccatcaggtagtaacaacgtcgatcatgatcggccaggtagaccgaacagacctcggtatccatcgcaagacagatgtcggtaaccagaatatttaacgcctcattcaggcgtggtgcgcaggctaccttttcgactatttcgcgcaggcgagtgagcataattggcgtgacttaacctcttttacgtcgataagcagatgcgttttgtggttttggcgtattttcctgcagtgacatcaccacactcgcgaactctttcattaccctacggtagacatcacgtttaaatgacaccacctgtctgactggataccagtaacttacccatcgccagccgtcaaactctggtgtactgctggtttgcatattgatttctgcatcgccgctcaccagctgcaagagaaaccatttttgtttttggccgatacaaaccggcttcgtgtcccaacgcaccaaacgtttcggtaatttgtagcgcaaccagttacgcgttgaagcaaggattcgaacgtctttgcggcttaatcctacttcttcaaacaattcacggtacatcgcctgctctgcggattctccggggttgattccgccttgcggaaattgccaggagtgctgaccaaatcgccgggcccacattacctgcccctggcgattacaaatcacgatacctacgtttgggcggtagccatcgtcatcaatcaccggactacctcaaaataaagctttatatacgaatgattgtttcatactccaggaagacggtaaaccactctctgcagggcattacacactaataacaattgaataactcacagttatgtgcagagttataaacagaggaaggggtggatagccgtttttattcaccttttctgtggatagagttgtgaagaactacggaattactacgggaaaacccggagcattctgaataagacagatatagagattttaaaatattcattatcagtcaatgcattacatgtgatttgagtaataaaaaagagtaattcgtgacccaggtcacacctctcatttacgtgttggcgaaagatcaaccaatgccgtatttatccacagaatgtgccactaagttaagcactgaaccactaaaaactggagtttcgtcgcacgtcaaggctgtaaatggaaacagtagtggaggtttttcacagttatcccagctttctgtggataacatggtgtaagatcctgtttattttcagtgaccagatttggaaaacccgttgcagtgttgcgcaactcgtttaccggcaacctaaaaagcaatataaatcagagaattgaacaacgcatgtggaaaaagttacactgcgaatattcagcacataattgctgtttgttttttaaccaaggtatcatgacatgtcccaacctcgcccactgctctctcctcccgaaactgaagaacaattgttagcgcaagcacaacaactttctggttatacattgggagaactggcggcacttgccgggctggttacgccggagaatttaaaacgcgataagggctggattggcgtgttactggagatctggctaggtgccagcgcagggagtaaacctgagcaagattttgctgctctgggcgtggaacttaaaactatccctgtggatagtcttggtcgtccactggaaacaacattcgtttgtgttgccccgttaacgggcaatagcggggtgacctgggaaaccagccacgtgcgccacaagctcaaacgcgtgctgtggataccggttgaaggcgagcgcagcatcccgctggcaaagcgtcgcgtaggatcaccgttgctgtggagcccgaatgaagaggaagaccgacagttacgcgaagactgggaagaattaatggatatgattgttctcggtcaaattgagcggatcaccgctcgtcacggggaatatttacagatacgaccgaaagcagcgaatgcgaaagcgctgaccgaagctattggtgcccggggcgaacggattctgacgctgccgcgcggattttatttgaagaagaatttcaccagtgcgctactggcccgtcattttctgatccagtagccatcgctttgacctgccgctttccgggcatataattaccgcttcatttttttggcagggctttttagatgttatttgcatggataaccgatcctaacgcctggcttgcgctcggtacactgacgctgctggagatcgttcttgggatcgacaatattattttcctttctctggtggtggcaaagcttcccacagcacaacgtgctcatgcgcgccgtctggggttggcgggagccatggtcatgcgtctggcgctgctggcatccatcgcctgggttacgcgcctgacgaatccgctttttacaatattcagtcaggaaatttccgcccgtgatttgatcctgcttctgggtggcttgttccttatctggaaagccagcaaggaaatccacgaatccatcgaaggtgaagaagaagggctgaaaacacgcgtttcatcattcctcggcgcgatcgtgcagattatgctgctggatattatcttcagcctcgactcggtgattaccgctgtgggtctgtcagatcacctgtttattatgatggctgccgtggtgattgccgtaggcgtgatgatgttcgccgcgcgctcgattggtgattttgtcgagcgccatccttcggtaaaaatgctggcgctctctttcctgattctggtgggctttaccctgattctggaaagtttcgacatccacgtaccgaaaggttacatctacttcgcgatgttcttctctattgcggttgaaagcctcaacctgattcgcaacaaaaagaatccgctctgatactccgtacgctctcctgcgggagggcgtactcactcctgttaccctcacagtttaagattttcctgctttcaagatatataacgtcggtttataaacagactattatcataggtgggccaaatgaggataaccggatgaaaaaatgggcagtaataatttctgcagtcggactggcgtttgctgtttccgggtgttccagtgattacgtcatggcgaccaaagatggccgtatgattttgaccgatggaaaacctgaaattgatgatgataccgggctggtgagttatcacgatcagcaaggtaacgcgatgcaaattaaccgtgatgatgtttcgcaaattattgaacgttaacaaataaggtcagcatccggctggccttaagatttttctctttcccttttcccttccctctgccatttttatattccttatgtcgtgattataaaaaggaaacggctatgcaatatcaccgtataccccacagttcgctggaagtcagcacgctggggcttggcacgatgacgtttggtgaacagaacagcgaagccgacgcccacgcacaactcgactatgccgtcgctcagggcattaaccttatcgacgttgccgaaatgtacccagtacctccgcgccccgaaactcaagggctaaccgaaacctacgtcggcaactggctggcgaaacatggcagccgcgaaaagttaattatcgcctccaaagtgagcggaccgtcgcgcaataatgacaaaggcatccgcccggatcaggcgctggatcggaagaatatccgcgaagcgctgcatgacagcctcaagcgtctgcagactgattacctcgatctctatcaggtgcactggccgcagcgcccaaccaactgcttcggcaaactcggttatagctggacagattctgcgcctgcggtttcgctgctggatacgctggacgcactggcagagtaccaacgcgcgggaaaaattcgttatatcggcgtgtcgaacgaaactgcatttggcgtaatgcgctacctgcatctggcggacaaacacgatctgccgcgtattgtcaccattcagaacccctacagcctgttaaaccgcagttttgaagtaggtctggcagaagtcagccagtatgaaggggtcgaactgctggcctattcgtgcctgggtttcggcacactgaccgggaaatatctcaatggtgcaaaacccgctggcgcacgtaatacgctctttagtcggttcacccgctatagcggtgagcaaacgcaaaaagccgtcgcggcgtatgttgatatcgccagacgtcatggcctggaccctgctcagatggcgctcgcatttgtacgccgtcaaccgtttgttgccagcactctgctgggcgcaaccacgatggagcagctgaaaactaacgtcgaaagtttgcatctggagttgagcgaagacgtattagctgaaattgaagcggtgcatcaggtttatacgtatcctgcaccataagattaacgccggttaaaaccggcgttaaatattaatgacggcgctgccagatccacagcgccgttattgccagcgcaaacagcgcaccgaagccaatgccaatgggcacgaccgggatgcctaccattaccgccagcgagtaaatgcccagcatcaacaacatggcgctgttttcgccaaggttttgtactgcaatcgcattccccgccccgacgctttttttaccccgctcctgtagcaacgcattgagcggaacgacaaaaaccccccccagcacgccaatcagcatcaacaaagcataggctggcagcagctcgtgttgcagggagaaaatcagtaccaccacgccaatcaaaatcccggctggcatacagcgtgacacggtttccagcgtaactaacttcgctgccgcacctgcaccaaccacgataccaatcgctaccatcgcgttgagataggtcggcgtagcgttatcggtaatacccagcgccaccggtacccacagcaccaacaggaaacgcagcgtgacacccgctccccagaataaactggtgcccaccagcgaaaaacgcgtttcaccattgcgccatagcgaggtgcaggcattcaggaaactgcgggtcatgctgatgagattccaggactgccccggacgcgccgccgccagtttgggaatgtagatattggcaacgaccgcgccaccgtaggccagtgcgcatgcggccagggcaaccagaatatgccagtcagccagaacaccaccagctacggaaccgagcaaaatcgccgctatggtagacgcttccattaaaccgttagcttttactaacttactacccgtggttaattcgccgagaataccgtatttcgccggtgaataggctgcagcaccaacacccaccaacgtatagccgagaaacggattgataccaaagcagatactggctgcgcccagtagcttcaggccgttggcaaacatcatcacccggcctttggcgaagctatccgccacctgcccgacaaacggcgcaaaaagaatgtaagcacctacaaacaccatttgcaggatgggctggctccactccggatagaactgcgctttcagtaacgccagagtggcaaacagtagcgcattatcgccaaacgcagagagaaactgcgccacgataaccgctttcatccccttcgaccacaacgaagtgttagtgtgcactgactcactcatcgtgttgttccgcttcgtctacccagcttttcaaagtgacaaagtcaggtttgccgctgccaagtaatggcatctgtttcagatagcgaatatcgcgcggtacagcaagctccggcacgccgtgctcgcgggcatactgttgtaacttatcgcgcatcagttcgttatctgtggtgaaaagcaccagtgcctcgcctttgctggcatcgctcttaatcgcagtggcatggactttatctggcgaaacaccaagtgccagttgttccaccatttccagcgacaccatttcgcctgcaattttggcaaagcgttttgcgcggccctgaatctgcacaaagccctgctcgtcaaaacgcacaatatcgccagtgtcataccagtcgcgctccatttcgccgcgaacattctcggcggtgggcacttccagtacacctggcttctccacccgcagatagccgttcattatgttcggccctttcagttgcaggcgtccgccctcttcgataccaggaaccgacaacaggcgcgcatccattcctggtagaatacgccctaccgtaccgggtttcgccgccatcggtacgttgatagaaacgacaggcgcgcattcggtcacaccgtagccttcaaggatgcgcaggccaaatttatcctgccaaagctgtttagtactttcttgtagtttttctgcgcctgccaccacatagcgtagacgatagaagtcatacgggttggcaaagcgcgcgtagtgaccgaggaaagtcgaggtaccgaacaacacggtgcaactgcggtcatacaccaactccggcacaatgcggtaatgcagcgggcttggataaaggaacacttctgcacctgtgagcagtggcgtaaacaggcctaccgtcagcccaaaggagtgaaacagcggtaacgccgacataaagcgatcgttggtggtgaagtcggcaatcgttttaatctgctcgacgttcgccagaatgcttttatggctatggacgacccctttcggatggccttcagaaccggaggtaaagaggatcagcgcctcttcttccggctgctgttttacctgtgccagacgcggcatcagcaaatgagcgaaaatccacactttgtcggcagtggtgacatctgcttttaaatcttccagatagacccagcgcacctgagtaagttgctccggcagatgccagagtttgcctttatcgagaaactgacgggaagtgaagatggttttgatttcagccgccgtaatagcactggtcaacccttttaccccggcggtgtagttcatcattgcgggaatgcggcgacgggcgatggccccaaaaatcactgccgcactgatgcctgcattgggcagcattaagccgatgcgttcgccttcaacactgtatttttcaaggatgcgtccaacaaacagcgttttcgtaagcaatttgcgataggagtccggggtaaagttaacgtcttcgacacatttcttcccggctccgaagcggtacattgcgctcagtaaagattcgtacagcgtttcacgcgggcgcaccgccatacgcgcttccatcattatttgatgcagcatttcgccagcgattttgcgacggtcacgggcacgcggcgcatccggcatctccacctgcgttggtggcaaaatatgcagagtaatttgcgggaacaagcgacgtttaaccagacctttcaggcggctgaagtgcgtaagttccgccccttcaatacgcacaggaataaccgttgcaccagacttcgccgcgacaaatcccgcgccatcgtagattttcatcagcgagccagtggtggtgatgcgtccttcagggaaaatcaccactggtcgtccctgttccaccagacgtaccagatgtttaatcgccataggttgcgtcgggtcgagaggaacaaagtcgataaatgatttcagccaacgcatataccactgttggcttattgaggtgtaaacggcaaataccggacgtacgggtaaaaacaatgccagcagtatgccatcaataaaagagacgtgattaggcgtaattagaacgcgctcgcccttcagtgccttggtgtcacccgtaacgcgaacgcgatacaaaacacggcacaaatttcgaaaaaagctaaaaagcattccaactccctttgctctgattcagtaaaagcgaatggagggagattacacgagataaagaacgcgagcgacagtaaattaggtgcgaaaaaaaacctgcgcatccgcgcaggttggtgcaagagactgggtacgaagagcgtaccgaataatctcaccaatcaatacctctgggatcttgattgtggtctgcacaacgactcttcgccagcgagaaaacgcaaaggaatgaagggaaatgcaacgaggtgtgtaaattgtcggttactgttacagattgatgaccggcaaaaaaaaacctgcgcatctgcgcaggctggtgtaattcatgtgctcaacccgaagttgacttcacctatcaatacctctgggatcaccactttagcaacctgaagccaaacgccaccagcggtcaatcgcaacagcgtttcgcaaagtgtaaccaaaggtttgcaatctctttttttgtcttacttatttgcgtttggctcacattcccacaatgaaaacacgccgccccttgaaccaacgggcgttttccgtaacactgaaagaatgtaagcgtttacccactaaggtattttcatggcgaccataaaggatgtagcccgactggcaggcgtttcagtcgccaccgtttcccgcgtcattaataattcacccaaagccagcgaagcttcccggcttgctgtgcatagtgcaatggagtctcttagctatcacccgaacgccaacgcccgtgcgctggcgcagcagaccactgaaacgatcggtctggtcgttggtgatgtttccgatccgtttttcggcgcaatggtgaaagcggtcgaacaggtggcttatcacactggtaattttttattgattggcaacggttaccacaacgaacaaaaagagcgtcaggccattgagcaactgatccgccatcgctgtgctgcgctggttgtccatgccaaaatgatcccggatgccgatttagcctcattaatgaaacaaatgcccggtatggtgctgatcaaccgtatcctgcctggctttgaaaaccgttgtattgctctggacgatcgttacggtgcctggctggcaacgcgtcatttaattcagcaaggtcatacccgcattggttatctgtgctctaaccactctatttctgacgccgaagatcgtctgcaagggtattacgatgcccttgctgaaagtggtattccggccaatgaccggctggtgacatttggcgaaccagacgaaagcggcggcgaacaggcaatgaccgagcttttgggacgaggcagaaatttcactgcggtagcctgttataacgattcaatggcggcgggcgcgatgggcgtgctcaatgataatggtattgatgtaccgggtgagatttcgttaattggctttgatgatgtgctggtgtcacgctatgtgcgtccgcgcctgaccaccgtgcgttacccaatcgtgacgatggcgacgcaggctgccgaactggctttggcgctggcggataatcgccctctcccggaaatcactaatgtctttagtccgacgctggtacgtcgccattcagtgtcaactccgtcgctggaggcaagtcatcatgcaaccagcgactaaccgcagttaaagcaattccagcgccagtaattcttcaatggtctggcgacggcgaatcaaccgcgcctgaccattatcaaacagaacttctggtaacagcggacggctgttgtagttggatgacattgatgcgccatatgcccctgtatcatgcagtaccagataatcacccgccttcacttccggcaaggcgcgggtttcgacatttcccccttcctgctgggtaaagacatcgcccgattcacataacggcccggcgacgacggtttccaccgttggtgcgtgttccagagaacgaccatcagctgccagggcactgatatggtggtaactaccgtacattgccgggcgcatcagatcgttgaacccggcatcaaccagcacaaagtggcggctacccatttgtttgacgctccgcacttgagtaattaatacgccagcctgcgctaccagaaagcgacccggttcaatttccagtttcacaggatggcccaaatggcgggcgatttgctcacgcgcggcattccacagaccataataatgttcggtatcaaccgcctcttcaccctgttgataaggaatagaaagcccaccgcccgcagaaatagcctgtaaatcctgaccgaattcgaggacctgacgcaccatagcaccacatacctgttccagatgggcataatcgacgccagaaccaatgtgcatgtgaatgccgaccagctgtagatgatgacgttgtatcacgtccagtgcggcgggcagatcggtgtaccagataccgtgcttgctgttttcgccaccggtattggttttttggctatgcccgtgaccaaaccccggattaacacgcagccatacccgatgccctagcgaaacctgacccagttggtcgagcatatcaacagaacccgcattcaccggaatttgcaattcactgacgcgttcaagcgtcgcctgatcgataacatctgccgtaaaaacaatatcatcggggtgcgtttgcggattgtaacccgccgccagtgcacgctctatttcgcctaacgagacggaatccacttttacgccctgctcacgcattaagcgcaaaatatgaatattggaacaggctttctgtgcaaagcgcaccacatcaaactgtttcagcgctgcaatctgccgacgaataatttgcgcatcgtagacccacaccgggcagccaaattctgcgggcaaacgcagcagattttcggcggtgagatcggtatcagtgctgaacagtgaatgtggcataacaaactccagataagtgcttttttatgattacgccacatcataaaaagaataaaaaatatcgatttatgtcgagtctatgcaaaaatgatatggattaccggattgcgagagagcgctaatggccgccgttaacttacgtcatattgaaatttttcatgcggtaatgaccgccggaagcctgactgaggcggcacacctgctacacacctcacagccaaccgtcagccgcgaactggcgcgctttgagaaggtgatcgggctgaaattgtttgagcgcatacgtggacgattacatcctaccgtgcaaggactgcgtctgtttgaagaagtgcaacgatcctggtacggactggatcgcattgtcagtgccgcagaaagtctgcgcgagtttcgccagggagaactgtctattgcctgcctgccggtcttttcgcaatcttttttaccgcagctcctgcaaccctttctggcacgttatcccgatgtcagcttaaacatcgtgccccaggaatcaccgctacttgaagagtggctctcggcccagcgtcatgatttaggactcactgaaacgctccatacgcctgcgggaacagaacgtaccgaattactctctttagatgaagtgtgtgtgttacctccgggccatccgctggcggtaaaaaaggtattaacgccggatgattttcacggtgagaactacatcagcctttcccgtactgacagctatcgccagttgctggatcaattgtttactgagaatcaggttaaacgacgcatgatcgtagaaacccacagcgccgcgtcagtctgcgcaatggtacgggcgggggtaggcgtttcggtggttaacccgctcaccgcactggattatgcggcaagcggtttagtggtgcggcggttcagcattgcggttccattcaccgtcagcctgatccgccccctgcaccgcccgtcatcagcgctggtgcaggcgtttagtgagcatttacaagcgggattaccgaaactggtcacttctcttgacgctattttgtcgtcagctacgacagcataaaagcgacagcatcctcggcatggatcgccgcggtatcaaacacaggcagaacactgcgctcttctggcaccagtaaaccaatttctgtgcagccaaaaatgacgccctgtgcgccctgttctgcaaggcgagcaatcacttgcgcataataagcgcgtgacgcttcggtaaattgccccagacacagttcttcaaaaataatctgattaatttttgcccgttcatccgcttcaggaataagacagttgatggaaaattgttccgtcagccgcccgcgataaaaatcctgttccatggtgtaacgtgtacccagcagcgccacacgagtcattcctgccccggtaattgcacatccagtggcatccgctatgtgtaagaaaggcagagagcaacgagactcaatggcatccgccactttatgcatcgtattggtgcataacacaataccttctgcgcccgcccgctgtaagccaagcgccgcctcagccagaatatccccggttttgtcccactcaccgcgacgctggcactcttctatttcatgaaaatcgacgctatgtagcagcacttgtgcagagtgaagcccaccaagccgctgtttaatgccttcatttatcagacgatagtaaggaatagtggattcccagctcattcctcccagcaaaccaattgttttcattcctctctcctgatgtgtgttaccgcaacaaggctgaataaggaacgagacaaacgcctcaacggccaggtgcctaatctctattaacgaaaaaagggccggatgtacagcacatccggcccgtgaaatcagacgccgatatttctcaacttttcgcctgccatcagtttgcgctcgatatgttccagcgtgacatttttggtttccggaatgagccagaaagtgatgcccacaaacgcaatgttcagcgcagtgtagagccagaacgtaccggcagcgccaatgctatcaagcagtgtcaggaaggtcgcgccgataatcatattcgacacccagtttgtcgtcgttgagcaggtgatgccaaaatcgcggcatttcagcggctgaatttcagagcacaagatccacaccactggcgcggcgctcatcgcataaccggcaatacacatcatcgtcatgccaacagagagccaggacaagccactggaagccgtaccgttatcaaactgcatcaggcagtaacccagcaccagagtgcctaacgccatcacgctgaaaccaattttcagagccggcttacgccctgctttatctaccgtaaagaccgcaatgaaggtagcgaacataaaggtcagccccacgaccagagtcgcaatcatctgttgttctgtggtcgtaaagcccgccattttgaagatacgtggcgcgtagtacatgatgatgttcataccggtaaactgctgcatcgcctgcaacaacataccgagaaatacagcacgacggacgttacggttgatcttaaacagtgcccaaccgccctgttttaacttcaggctttcacgaatttcgttgagttcttctcgcgctttttccgacgtatcgcgcagcatacgcaatacttcttccgcctcaatatgacgccccttttccgccagccagcgcgggctatttggcaggaagaccaccagaataatcagcagaactgctggtaaagcaagaacccccaacattgcgcgccagttaccgctataactgaacgctgtatcggataaaaacgccagcacgatgccgagagtgaccatcaactggtacatgctgatcatcttaccgcgaacgttttcacttgccatttcagaaagatatagaggagcggtgtaagacgcgatcccgacagcaatgcccaacaccacacgagcggcgattaacatctctacgctggtcgcaaaagcggaccctatcgaaccgagtacaaacaggatggcccccgccatcaggctgtatttacgccccaggcggaacgacagccaaccattaaacagcgcaccaattgctgcgccgagcatcatgctactgaccacccattcctgcaaacgactggtcagcacaaagtgatcggtaatgaacggcaacgctccggcgattacgccgatatcaagaccaaataacaatcctgcgaccgcagcagctaccgaaacaaacatattcatacgccgcatatcccgcagaggacgtggcgttaaagcagattccgtattgatagtaaccattttttcctgccagcagagagtaagacatagtgaaaaaatacgtgaacaattcacacaggtgtcaggtcggaaatagcataaatatggattaaattgctacgacatgtcgttatgtgatggatattccaattttcaaattaagttgaattattgagattattattaactacctaattttaaagcagataaaattcataaagttcattaattgataattgatatggattatttcataaccatgatatggattatgatgatctacaggtataaaaaaccctgccatgcggcagggtcataaaagtaagaggaatgaattaacgcgccagccaaccgccatccacagcaatggtataaccatttacataatctgaagcgctggaggcaagaaacactaccggccccatcaggtcactcggcagtccccaacggccagctggaatgcggtcgagaatttccgcgctacgttgttcatctgcccgcagttgttgagtattgttggtcgccatgtaacccggagctatcgcattaacattaatgttgtgtttagcccattcattcgccatcaatcgcgtcacgcccatcacgccgctttttgatgcggtataagaaggcacacggatcccgccctggaaggagagcattgacgcgatattgataatcttgccgccattgccttgcgcgataaagtgtttcgccgctgcctgagacatgaagaatacgctcttgatattcaggttcatgacatcgtcccagtctttttcgctgaattcgagagcgtcttcgcggcgaatcaatccggcgttattcaccaggatatcaatatgaccaaactcagctaccgcgcgatccagcagtgctggaatgccatcaatctttcgcagatcggcggtcaggcttaaaaaacgacgccccagcgccgtgacctgcttgatggtttcagtcggttcaacgatgttaatgccaacaatgtcacagcccgcttgcgccagccccaacgccatcccctggcccagcccagtatcacaaccagtgacgaccgcaactttaccttcgagagaaaatgcacttaaaatcataacaataccttattcgtttatgcccacaactagcgcaaatctttaacggccacatggtccatatcatcaaaaacctggttttcaccgaccatgccccagataaaggtataagctttggttccgacgccggaatggatcgaccagctcggggagatcaccgcctgctcgttatgcatcacaatgtgacgcgtttcttgcggttgccccatcatgtggaaaacgcaggcgtcatcatccatattgaaatagaaataaacttccatccggcgctcgtgggtgtgacacggcatggtgttccacaagttacctggagccagctccgtcagccccatactcaattggcaggtttccagcacatccgggacaaaatatttgttaatcgtgcgacggttactggtgaggttatcgcctaacgtgactggagatacttcgtccggtgtgacttttttggtgggatacgtcgtatgcgcgggtgcgcaattgtaataaaacttcgccggagtggcggtatcaatactggcaaagacaacttcttttgcacctttaccaacatacagggcgtcgcggtgaccgatttcatagcattgaccatcgacagtaatcgtaccggcaccgccaatattgataacacctaactcgcgacgttcaaggaaatagcttacgccgagttgtttaccaacttccccgccaacggaaaccgttttagttaccggcataatgccgccaacaataatacggtcaatgtggctgtaaaccatggtgtactcatcggcgacaaataccttttcaaccaaaaattcattgcgcagcccctgggtatccagcgtttttgcgtgcgcactgtggatgctctgtcttacgtccacatcaacctccgataatcagtgaagcgtgaaaatagaaaacaataataaaacactgtttcgttttctctatgaggggatgatatgcccatgggatagggttttcaattaaaaataaaacaatgtttcattttcaagttaaggattaaaaaaagtgcagtgtcgatcacgaatatgtcatgagaatggaaaaatcagggagccctgaaaaggtatgtcgactcaccagccatcattattcaacagattaatgacggcagatatttatcggtaaggaggaaatgcagagctactcgtcacgttcaatggtcaatgccacaccctggcccccgccgatacaaagcgttgccagtcctttgcgggcattacgtttcaccatttcatgaacaagagaaaccaggattcggcaaccggaagcgcctatcgggtgaccgagtgcgatcgcaccaccattgacattgacccgacgctcatcccattcaagcatcttgccaaccgaaagcgcctgtgcagcaaacgcttcattagcctcgataagatcgacatcagccaactgccagccaacacgctccaggcaacggcgggtcgcatacaccggcgcaattcccatcaatgccggatccacaccaacgctggcaaatgcgcggatgcaggccagcacgggtaaattcaacgctcgtgctttggcttcgctcatcatcattactgcagctgccccatcgtttatggatgatgcattacccgctgtcacagaaccgagactatcaaatgaaggatttaaacgggctaagccttctgcgctggtgtcagtgcgtggctgttcatcggtatcaacaaccaacgtctgtccgttactttgggttattaccgggacgatctcatctttaaatcgtccggcgtcaatcgccgctcgcgctttttgttgcgagctaagtgcgtaagcatcctgcaactgacggctgatgccatattcgcgagccagattttcggcggtgacaccaatatgataatcattgaaggcatcccacaacccatcatgcacaagactatcaaccaactggctattgccaagctgtgcgccggtgcggctatcagtcagaacatgtggtgcgcggctcatgttttcctggccaccggcgatgacaatatcagcctcgccacactgtatcgcctgagtagccagatgcagtgctttaagcccggaaccacaaacgtcattaatagtgattgcagaaacgctattaggaagaccacctttaatagccgattgtcttgccggattctgccctgcccctgcagtcaacacctgaccaagaatcacttcatccaccgcatatgcaggaacgccggtacgttctattaacgctttgacgaccaggctgccaagttccacggcggaatgacccgctaacgcaccacgaaagcagccgataggtgtccgtaacgccccgacaatcacaacgtctttcatcacaacctcgcaccaattaacagtgcaatagtaaatgattgttaattacagttatcttaattgtttaaaaaaagtgactattatcacaaaggaaatacgcctgagtagtagtcagagacataactggcacgtaaggtttgcaaccactaactcaccaatagagaggtagatagggcgttaatctcccatacttaacctggtttatggtaaattgccctccattttgtttaatttgtagatgatacgttcagataatgtctaatatttggtcaaaagaagaaactctgtggagtttcgcgctctacggcacagccgttggtgcaggcacgctcttccttcctattcagttaggttcggcgggggctgtggtcctgtttattactgctctggtcgcctggcctttaacatattggccacataaagccttatgccagttcatcctctcatcgaaaacatcagcaggtgaagggataacgggcgcggtaacacactactatggcaagaagattggtaatctgattaccacgctgtacttcatcgccttttttgtcgtcgtgttgatatatgcagtggcaattaccaactcacttacggaacagctggcaaagcatatggttattgatcttcgcatccgtatgttggtgagtctgggggttgtattaatcctgaatctcatttttctgatgggacgccatgcaaccattcgggtaatgggatttttggtattcccattgattgcctatttcttatttctttctatttacctggtcggtagttggcaacctgatctattaacaacccaggtagagttcaatcagaatacccttcaccagatatggatatcgattcccgtgatggttttcgcttttagccatacgcccattatttctacgtttgccatagacagacgtgaaaaatatggcgaacatgctatggataaatgcaaaaaaattatgaaagtcgcttatctcatcatctgcataagtgtattgttctttgtctttagctgcctgctttctattccaccttcgtatattgaagcggctaaagaagaaggggttaccattttatcggcgctttctatgctgccgaacgccccagcatggttatcaatttccgggattattgtcgcagtagttgcgatgtcgaaatcattcctgggtacgtactttggcgttattgaaggtgccacagaggtcgtcaaaacaacattacagcaggttggtgtaaagaaaagtcgtgcatttaaccgcgcactatcaattatgttggtatcgctgattaccttcattgtttgttgcattaacccgaacgcgatttcgatgatttacgcgatcagcggcccgctcattgccatgatacttttcatcatgcctacgctgtcaacgtatctcatcccggcgcttaaaccctggcgttccatcggaaatctgattacgctgatcgtgggtatcctgtgcgtatcggtaatgttctttagctaatatccgttgtggatggttcaaaattgcttcaattttgaaccatcccagttttcataatgttcatttgttattattccgccctatcacttctctcgtaatattatataattatcagctagttaaacacacaaagagttctgaacatcttaaataagactatttaagatacatgacgattgcattgcgtaaacgctttttatttacaaaaaatggggaagtattacggcgattgcgaaaagtctgaagcgcttgaattaagataatatagaaaatcagatacaacaaaaatggcaggtagatgatgtgaagataaattggagcgggcgaagggaatcgaaccctcgtatagagcttgggaagctctcgttctaccattgaactacgcccgcttcgagatgcgtaaggcattataaaccttacgctctccttagcaagtaccacgctgctgactgctgattaattcaccatcagcattttggcttgctgccctgaggcggcaagtaacgtagcggatcaattgccgttgcacggtaacgaatctggaaatgcaggcgaacagatgccgcatcagtgctccccatagtggcgattttttgcccagctttcacgctttgcccattatttaccagcatcgtgtcattatgagcgtaagccgtaatgtaatcttcactgtgtttaatcatgatgagattaccgtagccacgcagctggttacccacatacaccacctttcctgcacccgcggcgtaaataggtgtacctcgtggagctgagatatcaatccctttattgccgccatctgctgtcgaatacggcatgataactttccctgtcgttggccataaccaacaacgttgccctactggcggccaggaagatttcggtaccgctgatgacggtgtaaccgatgcggttttggtcgttgatttggcggttgatttacgtgtactactgctacttttcgccccacccagttttagtttctgacctacttcaatggtgtaagggggggaaatgccgttcagtcgcgccagttcttttacgctggttcccgtggtgcgcgaaatacgatatagcgtatccccccgtttcacggtgtaaacggagccggaatacgttcctgtatcggatgatttgctacccgaacagcccgccaaaagcagcccaaccgataacaacatcacgatacccagagattttttattcaggcgtcccgcactcaaaatctttcctcgcttaaaaaacaagacgccatatcatagcagccagcctcttgatacccaatctcttgcttctggaaaaacgatgtaatagagaaagaggttaatttcatttggcaaagggaagtatcatcagcaaaatatttgctgtagtggtatcgaagttcctgacttttaccctatttcccaccttgatgcgtaataatcctaatttatcacattgattttatcgccactcatattgatacgtatcactgtccctattcagagtcctgtttcgtatcatatctgtgtttttttaacgtcatcacacttccttcctcccctcacgcatatagtcgtttctggcgtaattcttgcctgctaagactaaatctttgccataagaaccaaatgttcaaaccgaggggatttctatggaagcgcgggaagcaaccgctacgggtgaatcatgcatgcgcgtcgatgccattgctaaggtcaccgggcgggcacgatatactgacgattatgttatggcgggcatgtgttacgcgaaatatgtacgtagtcctatcgcacatggttatgccgtaagtattaatgatgaacaagccaggagtttgccgggcgtcctggcgatttttacctgggaagatgtgccagaaatcccattcgccacggcagggcatgcctggacacttgacgaaaacaagcgcgataccgccgatcgcgcactgctaactcgccatgttcgtcatcatggcgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgtccgcgtaatttcgacacaagacaccgacgttacaccattcgaccccggcgcatttgcctcacgtcagagctatgttgccgcgcctgcgctgcgcagtgcggcactgttattaaaagagaaaatcatcgctcacgccgcagtcatgctacatcagtcagcgatgaatctgaccctgataaaaggccatatcgtgctggttgaacgaccggaagagccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgtaaagtcaccatcaaccgcatcctcaacgttcatgattcgggccatattcttaatccgctgctggcagaaggtcaggtacacggcggaatggggatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatccgcatacggacataagtcactgggtgagccacccataattcctgtagccgctgctattcgtaacgcggtgaagatggctaccggtgttgcaatcaatacactgccgctaacgccaaaacgattatatgaagaattccatctggcaggattgatttgaggataacatcatgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagcttcagggaataacacaggcggaagatggcgcgctgcgaatcggctccgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcacattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgaccaaaaaagtgattagcgaagccgtcgccgcggcggggggaaaattgcaatgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcacagcaatagacagttgcttattccttgcggcctgggctgaaggaaaagagatccgcacgctggaaggtgaagcgaaaggtggaaaactttctcatgtccaactggcttatgcgaaatccggcgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaaaaggatatccggcctgaattcaggccggattctcagaggttatgtgtttaacaactcatatttcttaatcttgcgatagagcgtagcaatgccgatgcccagttcatcagcaacttccttcttgctgttatgacgtgaaagcgcctcgcggatcatttgcttttccatctcctccagcgccgtgccgcccgcatcatcgagtgacaggtgcgcctcactgacctctgttacatcactttgctccgttgtgccattattcagcagatttggcggcaatagcgtgctgtcgataacttcacctgaaggaacaacgttaaccagatattccatcaaattgcttaactcgcgcaggtttccgggccaacgatgcttacgcaatatttcgacgacatcaggagcaatgccaggataaaccgatcccagacgacgggtatgcagatgtaaaaagtaatgcaccagtaattcaatatcttcctgacgttcacgcagcggtggaagagttatcgggataacattaagtcggtagaagagatcttcgcggaatttaccttcggcaatgaactgggccaaattctgattagttgcagaaatgatgcggatgtcgacttgtattgggctactggcaccaatcggcagaatttcacgcgcctcaatagcgcgcagtaatttagcctgcaacattaatggcatatcaccaatttcatcgagaaacagcgtgcccgtattcgccgcctgaatcaaccctgttttaccgttggcagaagcgccagtaaatgcgcctttaacataaccgaacagttcgctctccagaagctgttccggaatcgcggcacagttgatagcaataaagggtttattccgtcttccgctcaacttatggattgcacgggcgacgacttctttacccgtgccgctttcaccaaccaccataacgctggatgggctgggtgcaatacggctaatgagtcgttttaattgccgcataacacggcactcgccaaccaattgttcaatatgcggttcatcaggtgcatttgctacagaaaaactggtatgcgattggtgaaacgccattaaaaatagttgtcggccctggatgttatgcaactgaccaatgattaattcacttttatcatcccacgaaacaatatgttgcatatgaccatgggtaaaattactctcaaatgttaatggtctgaaacgaacaggttttccaataatattattttgtacaacaccgagtgtttttaaagctgtctgattaacaaactgaacacgattatcagcatcaaccactaacacgccctgatccatattatcgatcatggtcgcgaatattttactgatgttatctcctggtccctgatcctccagaagtttagaaacaaaaatggtggatatatggcgaacgtaatcggaaaattcgcgtaaattatcactgatatgttcttgttgctcgtgggtaacggcaatcaaacttatcaccccaacacaacgatcctgtaaaatgacaggcgtacccagaaatgctttttcgcggcaattttctttactatcgcaaccttcacaaaggggatcgaagcgagactgtgtcacaactttttcagttttcgtttccaggacgtggcggagcaggcgtgagttgccgctcaactggcggccaagaaacttcccatacgcgcccgttccggcgacgcgacacaagttttcatcaacgatctcaacctcaagctgcaaaacgctggcaagcattctggcaaaacgctgaattgtcggttgaatttgcatcaatactgactgcgtagtcgcaagctccatagctttaccttccagacttacttaaaagtcgatcattgaagacgttgatggttcacagatcatgatgatattaactcaggcgaaattggctttgataaaaacataagatttttatcactttctaataaaattatggaagagatatcacatttctatatcaatatgagaattacagcggcaagtttatcaaactgaagagagataccctgcctctttatcttatttctgatacttagcagcaaataaataacgcgataaaaaaagccaaacgttttcgtattttacaaacaaccggaagctggcatcaatttgtgatcaaccccacacattatccgtcaaattagtcttttgcagccccgaggataattctggcacacttattgttagtcccaggtatagctgtgaaaacaccaatcactttggcaagtcacagtgaaataaaccactttgcctgtcattccactaccgggactttatgatgaaaactgttaatgagctgattaaggatatcaattcgctgacctctcaccttcacgagaaagattttttgttaacgtgggaacagacgccagatgaactgaaacaagtactggacgttgccgccgcgttaaaagcactgcgtgctgaaaacatctcaaccaaagtctttaatagtggattaggtatttccgtattccgcgacaattccacccgtacccgcttctcttatgcttccgcgcttaacctgctcggccttgcacaacaagatcttgacgaaggtaaatcacaaatcgctcacggcgaaaccgtgcgtgaaaccgccaatatgatctccttctgcgctgacgctatcggtattcgcgacgatatgtatctgggcgcaggcaacgcttatatgcgtgaagttggcgctgcacttgatgacggctacaagcagggtgtgctgccgcagcgtccggctttagtgaacctgcaatgcgatattgaccacccgactcagtctatggctgacctggcatggttgcgtgaacactttggttcgctggaaaacctgaaaggcaaaaaaatcgccatgacctgggcctactccccaagctatggcaaaccgctctctgtaccacaaggcatcataggtctgatgacccgcttcggtatggatgtcaccctggcccatccggaaggctacgacctgatcccggatgtcgttgaagttgctaaaaacaatgctaaagcctccggtggtagcttccgtcaggtcaccagcatggaagaagccttcaaagacgcagacatcgtttatccgaagtcatgggcaccttacaaagtgatggaagagcgtactgaattgctgcgtgcgaacgatcacgaaggcttaaaagcactggaaaaacagtgtctggcacagaacgcgcaacacaaagactggcattgtactgaagagatgatggaactgacccgtgatggcgaagccctgtacatgcactgcctgccagctgatatcagcggcgtatcctgcaaagaaggtgaagtgactgaaggcgtattcgaaaaataccgtatcgctacctacaaagaagccagctggaagccttatatcatcgccgcgatgatcctgtcccgtaaatacgccaaaccaggtgcactgctcgagcaactgctgaaagaagcgcaagaacgcgtgaaataacccctcgggccgatcagctggtcggccctctatttccagaggccaaaaggataggatatgtccgttttctcattgaagattgatatcgccgataacaaatttttcaacggcgaaacatcaccgcttttttcgcaaagccaggcaaaactggcacgccagttccaccagaaaattgctggttatcacccaacaccgctttgtgcgctggacgatctcgcaaacctgtttggtgtaaagaaaattctcgtcaaagacgaatcaaaacgattcggtctgaacgccttcaaaatgctcggcggtgcgtacgccatcgctcaattattgtgtgaaaaatatcatcttgatatcgaaacgctgtcatttgagcacttgaaaaatgccatcggcgaaaaaatgactttcgcgactaccaccgacggcaaccacgggcgcggtgtggcatgggcagcacagcaactcggacagaatgcggtgatttacatgccgaaaggttctgctcaggaacgcgttgacgccattctaaacctcggtgccgagtgcatcgtcacggatatgaactatgacgataccgttcgcctgaccatgcaacacgcgcagcagcacggctgggaagtggtacaggacacggcatgggaaggttacaccaaaatcccaacctggatcatgcaaggctacgcaacactggcggatgaagccgtcgagcaaatgcgtgaaatgggcgtcaccccgacacacgttctgctgcaagccggtgtcggtgcaatggccggtggtgtgctgggttatctggtcgacgtctatagcccgcaaaatctgcacagcattattgttgaacctgacaaagctgactgtatttatcgctccggcgtcaaaggcgacatcgtcaacgttggcggtgatatggccaccatcatggcgggcctggcctgcggcgaacctaacccactgggctgggaaatcctacgtaactgcgccacccaattcatctcctgccaggacagcgttgccgcattaggtatgcgcgtgctgggtaatccgtatggcaacgacccgcgcatcatctccggtgaatccggcgctgtcggtttgggcgttctcgcagcggttcattatcacccgcaacgtcaaagcctgatggaaaaactggcgctgaacaaagatgccgtggtgctggttatcagcactgaaggcgacaccgacgtgaagcactaccgcgaagttgtctgggaaggcaaacacgctgtagcaccttaatcaccctattggaactgctccctgcaaaacggggagtaaaaaatctggagaaaaataatggctaagaatattccattcaaactgattcttgaaaaagcaaaagattaccaggcagacatgactcgcttcctgcgcgatatggttgctattcccagtgaaagctgcgacgagaaacgcgtagtacatcgtattaaagaagagatggaaaaagtcggcttcgataaagttgaaatcgacccaatgggcaacattctcggttatatcggccacggcccgcgtctggtggcaatggacgctcatatcgatacagtcggcattggcaacatcaaaaactgggacttcgatccgtatgaaggcatggaaaccgacgagctgatcggtggtcgtggtacttccgaccaggaaggcggcatggcgtctatggtatatgccggaaaaatcattaaagatctcggtctggaagatgaatataccctgctggtcaccggtactgtgcaggaagaagactgcgacggtctgtgctggcaatacattattgaacaatccggcattcgcccggaatttgtggtcagtaccgaaccaaccgactgccaggtataccgtggtcaacgcggtcgtatggaaattcgcattgatgttcagggtgttagctgccacggttcggcaccagaacgtggtgataacgccattttcaaaatgggtccaattcttggcgaattacaggaactgtctcaacgtctgggctatgacgaattcctcggcaaaggtacgctgactgtttctgaaatcttcttcacctccccaagtcgttgcgctgtagcagacagctgcgcagtttcaatcgaccgtcgtctgacctggggcgaaacctgggaaggcgcgctggacgagatccgcgctctacctgcagtacagaaagctaacgcggttgtttctatgtacaactacgaccgcccgtcctggactggcctggtttacccaaccgaatgctacttcccgacctggaaagtggaagaagatcacttcaccgttaaagcactggtgaatgcttatgaagggctgtttggtaaagcgcctgtcgttgataagtggaccttctcgactaatggcgtatccatcatgggtcgccacggcattccggtcatcggttttggccctggtaaagaaccggaagcgcacgcgccaaacgaaaaaacctggaaatctcacctggtaacctgtgccgctatgtacgctgcaatcccattaagctggctggcaaccgaataattactcttcacttattcccctccggttcgccggaggttttttggagtttgctatgcgcgtattgataaaaaacggcattgttgttaatgcagatggacaggcgaagcaggatttgctgattgaaagcgggattgttcgccagttgggtaccgatatttcgccgcaactcccttgcgaagaaattgatgcctctggctgttacgttttccctggcggcgtggatgtccatacgcatttcaatattgatgtcggcatcgcgcgcagttgtgatgatttttttaccggtacccgcgctgctgcgtgtggcggtacaacaaccattattgaccatatgggatttggcccaaatggctgccggttacgccatcaactggaagtttatcgcggttatgccgcccacaaagcagtcatcgactacagctttcacggtgtcattcaacatattaatcacgctatcctcgacgaaattccgatgatggttgaggaaggactgagcagttttaaactctatttaacctatcaatataaactcaacgatgatgaagtgttgcaggcattacgccgcttgcatgagtccggcgcgctgaccaccgtacacccggaaaatgacgcagctatcgccagcaagcgggcggagtttatcgccgcagggttaaccgcgccgcgttatcatgccttgagtcgacctctggaatgcgaagcggaagccatcgcccgcatgattaacctggcacaaattgccggtaacgccccgctctatatcgtgcacctgtctaacggcttaggtctggattatctgcgtcttgcccgtgcgaatcaccagccagtctgggttgaaacctgcccacaatatctcctgttggacgaacgcagttacgatacagaagatggcatgaagttcattcttagcccaccgctgcgtaacgtacgcgagcaggacaaactgtggtgtggcatcagcgatggtgcgattgacgtggtggcaaccgatcactgcaccttctcgatggctcaacgcctgcaaatttctaaaggcgatttcagccgctgcccaaatggcttacccggtgtggagaaccgcatgcaactgctgttctccagtggcgtgatgacgggacgtatctcaccggagcgttttgttgagttaaccagtgcaatgcccgccaggctgtttggcctgtggccacaaaaaggattattagcgcccggttccgatggcgacgtggtgattatagacccacgtcagagccaacaaattcagcatcgccatctccacgacaacgctgactactcgccatgggaggggtttacctgtcagggcgcgattgtcagaaccttatcccgtggtgaaacgattttctgcgacggcacctttacaggcaaagccgggcgaggtcgtttcctgcgacgcaaaccgtttgtccctcccgtgctctaaccactgccagggatctatacacaatcaagaatgatgagtgaggaaaaatgagtaagaaaattgttctcgccctgggcgggaatgcgctgggcgatgacctggctgggcaaatgaaagcggtaaaaattacttctcaggcaattgttgatttaattgcccagggacatgaggtcatcgtcactcatggcaacgggccacaggtgggcatgattaaccatgcctttgaagctgcagcaaaaactgaagcgcactcgccaatgctgccgatgtctgtctgtgttgccttaagccagggttatattggttacgatctacaaaacgccttaagagaagaactgctttctcgtggcattaataaacctgtagcaacgctggttacccaggtcgaagtcgatgctaacgatccggcattcctcaacccgaccaagccgatcggttcgttctttaccgagcaagaagcagagctactgacaaaacagggttacactctgaaagaagatgcgggtcgcggctatcgtcgtgtcgttgcttcgccaaaaccggttgatatcattgaaaaagaaacggttaaagctctggtagatgccggacaggtggtgatcaccgttggcggtggtggtatccctgttattcgtgaaggtaaccatctgcgtggtgccagcgcggttatcgataaagactgggccagcgcccgtttagcagaaatgatcgatgccgatatgctgatcattctgactgcggtagaaaaagtggccattaacttcggaaaagagaatgaacagtggctcgatcgcctgtcgttaagtgatgctgaacgctttatcgaagaaggtcattttgcgaaaggttctatgctgcctaaagtggaagctgccgcctcgtttgctcgctctcgcgcaggtcgtgaagcactgattaccgtattgagcaaagcgaaagaagggattgaaggcaaaaccggaacggtgatttgtcagtaatttaaaggccggatgggtaataccatccggccattttcatttaagccacttccagcacttcttttgtcgctttaacgccctgatgcatcaacatcattaacgcctcaagtacgccgccgccaatcgcccgggctttatcagaaacgctggtgaaatcagccgtttcaccacgaggatcgatatcaccaattttaaaaccaccgaccacggccagtccgtcgttcaacaagccacgcaccatccccgtcaacggtgctttaatttcatgctcaccaatccaggcaatgacatcgccctctttcaccagatcgcctaatttcacgttggatcgcataatgcctgcagcaggagcacggatcacccgtcgggtggtatgccccataatattgccgggaacaccggtattctcctgcgcacaaccagagtaaatcacctgaccgagccagtgcccgcgatttgtttcaattaccgcatgacaatccttccctgcagtaaagcccggcccaagcgcgattgttactggtgccatatctgcccgcgttcccaaattctgtttcgccagaatagcgtccaccacgcaaagcggtttcagttcatcaagcaatgaacaggtgggatctaccatcacagggataaatccgcgttcggtaagtttcatcgcttccgcagagctggttgccaggcgggcggtgacgccttcgaccgtcatttcgccatcgaacacggcctgggcaaacgccacggtacaacgaatcactgtcggtttttccacttccaacatgatcactttaaaacccgcatgatacagacgtagcgctacaccactggcgatatcccccgcaccacgaatcaccaccagctggtgtccggaaggatgagaaggcttcatcatcagcccacccggcgcgttatttttcacctgtaatatttctgccagcacgctgatggcgatctcctgcggcgtttccgcacctatgttgtaaccaacgggcgcatgtaaacgggcaatatgttcttcagccacgcctttctcacgcaattggcgcaggaaaagctgaaccttgcggcgacttgccagcaaccccagccatgcaatgggttgttcaatgagtttgtcgagggcttcacgatcctgattattcgtggcaatcaggacaaaattatcagggcgaatatccagtgcttccactgccgcaccaaacgactcagcatggagaagcgtggttgatggtgggaatagttcaggattgaggctttcgcgataaatatcagcaacggcgatatcaaatcctaatagcgccgcactctgggctatcgcccggttgacatgccccgcaccaatcaacaccagacgtggacgcataccatggacgctgataaatactgacattgcacctccacaatctgacccgacagcatccgcaccgttacgagccatacgtccatggaataatcgcggcttacgttcctgcaatgcctgaagcgactcttcaatcaccttccgttcaaccattccgccaccaattgtaccgacgatagaaccatcggcgcgcactaacatttgtgcagaatggcggggggttgagcctcggctatcaacaatttgcgccatcgcaaacggacaattttgctcttcgagttttgcagcctctgtgaaaatattcataccaacctcaatggatatcctttcagtaacccggaatacccgggccgctaattcacaaatctgcgcgcgattgcaggatgttcttgtatatcgcccagccagattgcctctacgttgtgttgttgcagcggttgaaggagctcgctttgcgcaatcgcattctcacattgagaaaaacggttaatgaaccagactcgccgacaaccttgcggtacgtttttaaacgccccctgagggtggcgaaccagcgcaacgagatcgctcagttgcaagggtgcatcaggtgttaacccagtaatatcagcaaactgcgaccagcgatggacattttctgtgctcactttcgcacccaaaatatgtcctcccatcacagcaatcacgcagcaactgcttttaggtatgcaaggttcgtgctcatcaggcgcttttaacggcattccacgcgagccatctgcctcaatgagaattacgtcacactctggtcgttgtaccagtgcatcaatcgcttctggcgtaaatccctgcacttttccctggttcgctttccagcagtgaaaacaaaatgaaatgggggatataaaagacgcatgaggaagcatggcgggatcacgacagaaaaccacgggccagtgagatgttggcataaacatatgtgtcgtcgtagtgattaatacacgcctgccactcgcctggaacagttctgccagccaaaaaagcaagctggttttccccccagcaccaacaatagaaatcacagtgggacgtttctgcgcgcctaaatcaatgaataatgccgatgggtcaattatacttttcacgcgtctttatggacctctctgggataaattaccctcaacgtaatccatcaggaagtaacgcaattatcaggcgttattagctcctgtaaataatggaatcactatgtcagccatcgactgtataattaccgccgcaggattatcatcaagaatggggcaatggaaaatgatgttaccctggcaacagggaacaattcttgatacaagtatcaaaaatgcgttgcagttttgtagccgaattattttagtcaccggctatcgtggtaatgaactgcacgaacgttatgcgaaccagagcaatgtcactattatccacaacccagattatgcgcagggtttactgacatcagtaaaggccgcagtacccgcggtgcaaacagaacattgttttctcacccacggagatatgccaaccctcaccatcgatatttttagaaaaatctggtcgttacgaaatgatggcgcaatactgccactccataatggcatccccggccatccgattttagtgtcaaaaccatgcctgatgcaggcaatccagcgacccaatgtcaccaatatgcgtcaggcactccttatgggagaacattattccgtcgaaatagaaaatgcagaaataattttagatattgatactccggacgactttattacagcgaagaaaaggtatactgaaatttagaaaacgtagttaaacgattgcgttcaaatatctaatccctccagcactctttatcataatgataaggaatcactgattttgagaaaagagaaaaagtgataaatgggctggcaataataattttcaggagtgattttaattctcatttggcacctgtgagttcattcacaaaaagccattaagtttcgagccgcctcacatttttttatatttcccgccaaacctggcaagagtggtgcgattgttgctctatccccctaaaccaccggatttctcaacaccggtcactcaatgatatctgtataagctaaggagagggttatgggggatattatgcgtcccattccgtttgaggaacttttgacgcgcatatttgatgaataccaacaacaacgctcaatctttggtattcccgagcaacagttttactcacccgtaaaaggtaaaactgttagcgtcttcggtgaaacctgtgccactcccgtcggccctgccgctggcccgcacacgcaacttgcgcaaaacatcgtcacctcctggctgactggcggacgcttcatcgaactaaaaaccgtccaaattcttgaccgcctggagctggaaaagccctgtatcgatgccgaagacgagtgctttaacaccgaatggtctaccgaatttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcagcagttcatcgacaatatgatggacgcatctgaccatccgaaattcgctcaataccgcgatgcacttaataagctactccaggatgaggcatttttagcccgccacggattgcaggaaaaacgcgaaagcttgcaagccttacccgctcgcatccccaccagcatggtacaaggggttaccctctccaccatgcacggctgtcctccgcatgaaatcgaagccatttgccgctacatgctggaagaaaaagggctcaacacctttgtgaaactcaacccgaccttactggggtacgcgcgtgttcgtgagatcctcgatgtctgcggtttcggttacatcggcttaaaagaagagtcatttgatcacgacctcaagctgacgcaagcactggaaatgctggaacgcctgatggcactggcaaaagaaaaatcactcggctttggcgtaaaactgactaacactctcggcaccattaataacaaaggcgcactgcccggtgaagagatgtatatgtcaggccgtgcgctgttcccgctctccatcaacgttgcagcagttctctctcgcgcctttgacggcaaactgcccatttcttattccggtggtgccagtcagctgactatccgcgatatttttgatactggtattcgccctattactatggcaaccgacctgctgaaacctggcggctatctgcgcttaagtgcctgcatgcgcgagctggaaggctcagatgcctgggagcttaaccacgttgacgtcgaacgactgaacagactggcagcagacgcgttaaccatggaatacacccagaaacactggaagccagaagagcgtattgaagtggctgaagacctgccgctgaccgattgctacgttgccccctgtgttactgcctgcgctatcaagcaagatattccggaatacatccgtctgcttggcgaacaccgctatgccgacgcgctggaactcatctatcaacgcaacgccctgcccgccattaccggtcatatttgcgatcaccagtgccaatacaactgtacccgcctggattacgacagtgcgctgaatatccgcgaactgaaaaaagtcgcgctggaaaaaggttgggatgaatataagcaacgctggcacaaaccagccggttctggttcacgccatccggttgccgtgattggtgcaggtccggcgggtctggcagcaggttacttccttgccagagcgggccatccggttacgctgtttgaacgcgaagccaatgcgggcggcgtggtgaaaaatatcattcctcagttccgtattcctgcagagttaattcagcacgatatcgattttgttgccgctcacggcgtaaaatttgagtatggctgctcacccgatttgaccgttgaacagttaaaaaatcagggcttccactatgttctgattgccaccggcactgataaaaatagcggtgtgaaactggcgggcgacaaccaaaatgtctggaaatcactccccttcctgcgtgaatacaacaagggcaccgcgctcaagctgggcaaacatgtggtcgttgtcggggcgggtaacaccgcaatggactgcgctcgtgcggcgttacgcgttccaggcgtagaaaaagcaacggtcgtttaccgtcgttcactgcaagagatgccagcatggcgcgaagagtatgaagaagcgttgcacgacggcgtggagttccgttttctgaataatccggaacgtttcgatgctgatggcaccttaaccttgcgcgttatgtcgcttggcgaacctgatgagaaaggtcgtcgccgtccggttgaaaccaacgaaacagtaacgctgcatgtagacagcctgatcaccgccattggtgaacagcaggatactgaagccctgaatgcaatgggcgtgccgctggacaaaaacggctggccagacgtcgaccataatggcgaaacacgtctgactgacgtctttatgatcggcgacgtacagcgcggaccatcctccattgtcgctgctgtcggaaccgcgcgtcgggcgaccgatgccatcctgagtcgggaaaatatccgttcccaccagaacgataaatactggaataacgtcaatccggcggaaatctatcaacgtaaaggcgatatctctgtcactctggtgaacagtgacgatcgtgacgcgtttgtcgcgcaggaagccgctcgctgccttgaatgtaactacgtttgcagcaagtgtgtggatgtctgcccgaaccgcgccaacgtatccattgcggtcccaggcttccagaaccgtttccagacgctgcatctcgacgcctactgcaacgaatgcggcaactgcgcccaattctgcccgtggaacggtaaaccgtacaaagacaaaatcaccgtcttcagcctgtcgcaagactttgataacagcagcaacccaggcttccttgtggaagattgccgggtacgcgtacgtctgaataaccaaagctgggtgttaaacatcgacagcgaaggtcagttcaacaacgtaccaccggagctgaacgatatgtgccgcatcattagccatgtccaccagcatcatcattatctgctgggccgcgtggaggtgtaatcatgttgattctgaagaatgtcaccgcagtgcagttacacccggcgaaagtgcaggaaggcgttgatatcgccatcgaaaatgatgtgattgtcgctatcgacgatgccctgacgcaatgctatcccgatgccagctacaaagagatgcatggtcggattgtgatgccgggaattgtctgctcgcataaccatttttactcggggctttcccgcggaattatggcaaacatcgccccctgcccggatttcatctcaacgctgaaaaatctctggtggcggctcgatcgcgcccttgatgaagagtcgctctattacagcggactgatttgttccctggaagcgattaagagcggatgtacatcggttatcgatcaccatgcctctccagcctatatcggcgggtcgctctccacattgcgcgacgcatttttaaaagttggcctgcgcgcgatgacctgttttgaaactactgaccgtaacagcggcatcaaagagttgcaggaaggtgtagaagaaaacatccgcttcgcccgtcagattgatgaggcgaagaaagcagcaaccgagccgtatctggtggaagcacatatcggcgctcacgcgccgtttaccgtaccggatgccggtctggagatgctgcgtgaagccgtgaaaagcacaggtcgtggtttgcatattcacgctgcggaagacctttacgacgtttcctacagtcaccattggtacggcaaagacctgctggcacgactggcgcaattcgatctcatcgacagcaaaacgctggtcgctcatgggctgtacttgtcgaaagatgacatcgccctactcaatcagcgcgatgcgttcctggtgcataacgcccgttcaaacatgaacaaccatgtcggctacaaccatcaccttagcgacatccgcaatctggcgttgggaacggacggcattggttcggacatgtttgaagagatgaaatttgccttctttaaacatcgcgatgcgggtggcccgctgtggcctgacagttttgccaaagcactggctaacggcaacgaactgatgagccgcaactttggcgcgaaatttgggcttctggaagccggttacaaagccgatttaaccatttgcgattacaactcgccgacgccgctgctggcagacaatatcgccgggcatatcgctttcggtatgggctcaggcagcgttcacagcgtgatggtcaatggtgtgatggtctatgaagaccgtcagtttaacttcgattgcgattccatttatgcgcaagccagaaaagccgctgccagtatgtggcgtcggatggatgcgctggcataaataacagctcccctcttctttcagagaagaggggaaattaaggaaagacgatgattgaacaatttttcagacccgactcagtcgaacaggcgctggaactgaagcgccgctaccaagatgaagccgtctggttcgccgggggcagcaaactcaacgctacaccaacccgtaccgataaaaagattgccatttccttgcaggatctggagctggactggattgactgggataacggtgcactacgaattggcgcaatgtctcgcttgcagccactgcgtgatgcgcgatttattcctgcagcactgtgtgaagccctcggttttgtttactcacgccatgttcgtaatcagtcgaccattggtggtgaaatcgccgcccggcaggaagagtcggtgctgcttcccgtcctgctggcactggatgctgaactggtttttggcaacggcgaaacgctgtcaatcgaggactacctggcctgcccatgcgatcgcctgttaaccgaaattatcattaaagatccgtatcgcacctgtgcgactcgcaaaattagccgttctcaggcaggtttaaccgtcgtgacggcagccgttgcaataacagaccacgacggtatgcgaattgcgctggatggcgtagccagtaaagcactgcgtctgcatgatgttgaaactcaaaatctggaaggcaatgcacttgaacaggctgtcgccaacgccattttcccgcaggaagatttgcggggcagcgtggcctataaacgctatatcacgggagttctggtagccgacctgtatgccgactgccaacaggctggggaggaagccgtatgatcatccactttactttaaatggcgcgcctcaggagctaaccgttaatccaggcgaaaacgtgcaaaagctgttgtttaacatgggaatgcactctgtacgcaacagtgatgatggttttgggtttgccggttctgacgcaattatctttaacggtaatatcgttaacgcgtccttgcttatcgccgcacagttagagaaggcagatattcgtaccgcagaatctctgggcaaatggaatgagttaagtctggttcaacaggccatggttgatgttggcgtggtgcagtctggttataacgatccagctgcggctctgattatcaccgatcttctcgatcgcatcgacgcacctacccgcgaagagatcgacgacgcactctcaggtctgtttagccgcgatgctggctggcagcaatactatcaggtcattgaactggcggttgcacgtaaaaataatccgcaggccaccattgatatcgctccgactttccgtgacgaccttgaagtcattggcaagcattatcctaaaactgatgccgcgaaaatggtgcaggcgaaaccctgctatgttgaagatcgagtaacggctgacgcctgcgtcattaaaatgttacgtagcccacacgctcacgcactgattactcatctggatgtcagcaaagctgaagccttaccgggcgtcgttcacgttattactcacctgaattgcccggatatttactataccccgggtggtcagagcgcaccggaaccgtcaccgcttgaccgccgaatgttcggcaagaaaatgcgtcacgtcggcgatcgcgttgctgcggtagtagccgaaaatgaagacattgcgctcgaagcactgaagctcatcgacgttgaatatgaagtgcttaagccggtaatgtcgattgacgaggcaatggcggaagatgcgcctgtcgtgcacgatgaaccggtggtgtatgttgctggtgcgccagatactctggaagatgataacagccatgcagcccagcgcggcgagcatatgatcatcaacttcccgatcggttctcgcccacgcaaaaatatcgctgccagtattcatggtcatattggcgatatggacaaaggctttgccgatgccgatgtgatcattgagcgaacctataactcaacgcaggcgcagcagtgcccgactgaaacacatatctgctttacccgtatggacggcgatcgtctggtgatccacgcctccacccaggtaccatggcacttacgccgccaggtcgcgcgcctcgtgggcatgaaacaacataaagttcatgtcattaaagaacgtgtaggcggcggttttggttccaaacaggacatcctgctggaagaagtgtgcgcctgggcaacctgcgtgaccgggcgtccggtactgttccgctacacccgtgaagaagagtttattgctaacacctctcgtcacgtcgcgaaagtcaccgtcaaactgggcgcgaaaaaagatggtcgcctgacggcagtgaagatggatttccgcgccaacacgggtccttacggtaaccactcactcaccgtaccgtgtaacggaccggcgctgtcgctgccgttatatccatgcgataacgtcgattttcaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgcgcactggaagagatcctgcgtcagggtcgcgagatgatccaatggtcttcaccaaaaccgcaaaatggtgactggcacatcggtcgcggcgtcgccattatcatgcagaaatcgggtatcccggatatcgatcaggctaactgcatgatcaaactggaatcggatggcacctttatcgttcattccggtggtgcggatattggtactggtctggatactgtggtgaccaaactggcagcagaagtgctgcactgcccaccgcaggacgtgcatgttatctctggtgataccgatcatgcactgtttgataaaggcgcatatgcctcgtccggtacttgcttctcgggtaacgctgcgcgtttggcagcggaaaatctgcgggagaaaatcctgttccacggcgcgcaaatattgggtgagccagtggcagatgttcaactagcaacgccgggcgtcgttcgcggcaagaaaggcgaagttagtttcggagagatagcccataaaggcgaaaccggcaccggctttggttcactggtgggaactggcagttatatcacgcctgatttcgccttcccgtatggcgcaaactttgctgaagttgccgtcaacacgcgtacgggtgaaatccgcctggataaattctacgccttgctggattgcggtacaccggtcaatccagagttagcgttaggacaaatctacggtgccacccttcgtgcaatcggccacagtatgagcgaagaaatcatttatgacgccgaaggtcacccgttaacgcgtgatttacgcagttacggcgcaccgaaaattggtgacattccgcgtgatttccgcgctgtgctggtgccgagcgacgataaagtcggcccattcggggcgaaatcgatctcggaaatcggtgtaaatggcgccgctccggcgattgctaccgcaattcacgatgcctgcggcatctggttacgcgaatggcatttcacaccggagaaaatactcaccgcgctggaaaaaatataagtaataaatggccgcttcggcggcctgtttctctgtttgaacgatgactaaatagtgactgcgaaaatgagataagccgttctcaaggcgtcctgcgccccaaattcgtgggaatttattttactaattcagatgatcaaatttactttaaaaggagtgaagggatgtctgatataaaccatgcaggttctgaccttatatttgaactggaggatcgccctccctttcatcaggctctcgtaggtgccattacccatctgttggcaattttcgttccgatggtaacccccgcgttaatcgtgggtgcggccttacagctttccgctgaaacaactgcctatcttgtttctatggcgatgatcgcctctggtattggtacctggttacaagtaaaccgctacggcatcgtcggttctggtttactttcaattcagtcagtcaatttttcatttgttacggtcatgattgcgctgggtagcagcatgaaaagcgacggttttcacgaagagttaatcatgtcgtcgctcctcggcgtctctttcgttggcgcatttctggttgtcggctcttcttttatcctgccctatttacgtcgggttattacgcctaccgtcagcggcattgtggtgctgatgatcggcttaagcctgattaaagttggcattattgattttggcggtggttttgcagctaaaagcagcggtacgttcggcaattacgagcatctcggcgttggcttattggttttgattgtggtgatcggctttaactgctgccgcagtccgttgctacgcatgggtgggatcgccattgggctatgtgtcggctatatcgcatcgttatgcctgggcatggtggatttcagcagtatgcgcaatttgccgttaatcaccatcccgcatccgttcaaatacggctttagttttagcttccatcagttcctggtggttggcacgatttatctgcttagcgtgctggaagctgtcggcgatatcaccgccacggcaatggtttcccgccgtcccattcagggggaagagtatcagtcccgactgaaaggcggcgtgctggcagatggtctggtttctgttatcgcctccgctgtcggttcattaccattaaccacgtttgcgcaaaataatggggttattcagatgactggcgtcgcttcacgttatgtcgggcgaaccatcgcggtaatgctggttatcctcggcttatttccgatgattggcggcttttttacgaccattccctcggcagttctgggaggcgcaatgacgttgatgttttccatgattgccatcgcagggattcgcatcatcatcaccaacggtttaaagcgccgagaaacacttattgtcgccacttctttaggtttaggacttggcgtctcctacgatcccgaaatttttaaaatattgccagcctctatttatgtattagttgaaaaccctatttgtgctggcgggttaactgcgattttattaaatattatcctccctggtggctaccgacaggaaaacgttctgcctggtattacctcagcggaagagatggattaacagtaaaggagtcaatgatgtcaggagaacacacgttaaaagcggtacgaggcagttttattgatgtcacccgtacggtcgataacccggaagaaattgcctctgcgctgcggtttattgaggatggtttattactcattaaacagggaaaagtggaatggtttggcgaatgggaagacggaaagcatcaaattcctgacaccattcgcgtgcgcgactatcgcggcaaactgatagtaccgggctttatcgatacacatatccattatccgcaaagtgaaatggtgggggcctatggtgaacaattgctggagtggttgaataaacacaccttccctactgaacgtcgttatgaggatttagagtacgcccgcgagatgtcggcgttcttcatcaagcagcttttacgtaacggaaccaccacggcgctggtgtttggcactgttcatccacaatccgttgatgcgctgtttgaagccgccagtcatatcaatatgcgtatgattgccggtaaagtgatgatggaccgaaacgcaccggattatctgctcgacactgccgaaagcagctatcaccaaagcaaagaactgattgaacgctggcacaaaaatggtcgtctgttgtatgcgattacgccacgcttcgcccctacctcatctcctgaacagatggcgatggcgcaacgcctgaaagaagaatatccggatacatgggtacatacccatctctgtgaaaacaaagatgaaattgcctgggtgaaatcgctttatcctgaccatgatggttatcttgatgtttaccatcagtacggcctgaccggtaaaaactgcgtctttgctcactgcgtccatctcgaagaaaaagagtgggatcgtctcagcgaaaccaaatccagcattgctttctgtccgacctccaacctttacctcggcagcggcttattcaacttgaaaaaagcatggcagaagaaagtcaaagtgggcatgggaacggatatcggtgccggaacaacttttaacatgctgcaaacgctgaacgaagcctacaaggtattgcaattacaaggctatcgcctctcggcatatgaagcgttttacctggccacgctcggcggagcgaaatctctgggccttgacgatttgattggcaactttttacctggcaaagaggctgatttcgtggtgatggaacccactgccactccgctacagcagctgcgctatgacaactctgtttctttagtcgacaaattgttcgtgatgatgacgttgggcgatgaccgttcgatctaccgcacctacgttgatggtcgtctggtgtacgaacgcaactaataataaaactttaacatcctcgtgaggacatcattatgtctggagacatcctacaaacaccggacgcaccaaagccacagggcgcgctggataattattttaaaattaccgctcgtggcagtaccgttcgtcaggaagtactggctggcttaacgacctttctggccatggtttattccgttatcgtcgttccgggaatgctgggcaaagcaggttttcctcccgcagctgtgtttgttgccacctgtctggtcgcgggcttcggctcgttgctgatggggttatgggccaatttgccaatggcgattggttgcgctatttccttgacggcgtttaccgcattcagtctggtactcgggcaacaaattagcgttcctgtcgcactgggcgcagtctttctgatgggcgtcatcttcaccgctatttccgtaaccggtgtgcgtacctggatcttacgtaatttgccgatggggatcgctcacggtacaggtatcggtatcggcctgtttctgctgctgattgctgctaacggtgtgggaatggttataaaaaacccgattgaaggcttgccagtggcgctcggtgcctttacctccttcccggtgatgatgagcttactggggctggcggtcatcttcggtctggaaaagtgccgcgtacccggcgggatcttgttggtgattattgcaatttcgatcatcggcttaatctttgacccagcggtgaagtaccacggtctggtggcgatgccaagcctgactggcgaagatggtaagtctctgattttcagcctcgatattatgggcgcactccagccaactgtacttccgagtgtactggcattggtgatgaccgcagtgttcgacgccactggcaccatccgtgccgtcgccggtcaggcgaatttgttggataaagacaaccagatcatcaacggcggcaaagccctgaccagtgactcagtaagttcaatattctccggcctggtgggcgcagcgcccgcggcggtttatatcgaatcagcggcaggaaccgccgccggggggaaaaccggtttaaccgcaaccgtggttggtgtgttgttcctgatgattctgtttttatcaccgttatcgtttctgatccccggttatgccacagctcccgcactgatgtacgtgggtttgctgatgttaagcaacgtctcgaagctggatttcaacgattttattgacgcaatggctggcctggtgtgtgccgtgttcatcgttctgacttgtaatatcgttaccggtattatgctgggctttgtaacactggtggtgggtcgcgtctttgcgcgcgaatggcaaaagctgaatattggtacggtgatcattactgccgcactggtcgcgttttacgcgggtggttgggcaatctaatagattctccgcgcctttccgcgcggagatttctttcagagaggattctcaccgctggcaacaatacgctgctggcggactcgcctgagttctctttcagtcagcaactgcagcgcctgtgtcgggcaagattcaacgcaggctggcccctcttcccgctgttcacagagatcgcatttcacgatttgttgccgggtatcccccggcaatgactgaatggtgatcattccaaacgggcacgcactgacgcaactctgacagccaatacaacgggcagaatttgcctgcaccacctgctcgcccatcgtcagcgcccccacgggacaagcgccaacacaaggggcgttttcacactgatggcacatcaccggcgcactgatgctatccagccgttgtaccttcagccggggtaaaaagatatcggcattcaactcctgttctgaagggtgagcgaccacacaggccacttcacaagtacggcagccaatacagtcagccggattaacgataattaacgatttcatcacgatgccttcgtatcaaacagagttaacatatcgcgcgccgcctgccttcctgcggccattgcagtgacaaccagatccgcgccatgaactgcatcaccaccagcaaagacttttttcagatgcgtctgggtgggtaaatacccgacgtcgccggtttgaatcaggccccatttatcgagtttaattccgctgccctgcaaccacggcatggtatgtgcctggaaaccaaaggccataatgagaacatcggcgggcaattcaaactctgaacccgcaaccggacgaggacgacggcggccatccggccccggctcacccatagcggtacgaatcaggcccaccgccgttaagcgtccatcttcatcacaagcgatatattgcggctgaacattgaactgaaactcaacaccttcctcgcgggcattgaccacctctttgcgcgaacccggcatactgacttcatcacgacgatacgcacaggtcacgctggcagcattaaggcggatggaagtccgcaaacaatccattgtcgtatcgccaccgcccaataccacaactcgcttaccttccacatccgtcagcggatactctgcagactccggcaatcccatgagctggcgggtatgggcggtcaggaacggtaacgcctgaatgacaccaggcgcatcttcatgcggcagatctgctcgcatcatcccgtaagtccccacgccgaggaaaacagcatcatattccgccgttaattcgttgaaagagatatcgcggccaatttcacagttgagatggaaatcgattcccattgcgatgaatatctctcgccgctggcttaataccgttttatcgagtttgaaaggaggaatgccaaaagtcagcataccgccaatttctggatggcgatcaaagacatcaacctgaactcccgcgcgcgccagaatatcagcacaccctaatcctgcaggtccagcgccaatcaccgccactttttcgctacggggaacaactttgctgacatcgggacgccagcccatcgccagcgcagtatcggtgatgtagcgttccagattaccgatagagactgcgccagagtgatctttcaaagtacatgcgccttcacaaagacggtcctgtggacataccctgccgcagatttcgggtaaggaactggtctggtggcaaagttctgccgcttcaataatctttccttcctgtaccagacggatgtaatccggaatagcgttatgcagcggacaatgccagttgcagttagctttttcggcacaataaacacagcggtcactctcataagtcgcttgttgtggatccagcccgcaatagatttcgccaaagtgggttttccgttcactcgctgaaattttatctgcgcctttacgcgagttaacggggagcaacgctgcactgcgagatggctgagcgtctgatgacgcttttcctgctgccgttttgcgctggcgggccacctttatctgctgcaaccctttatcgtccatcagccgtaacgcctgtgttgggcagacgtcaatacaggcttgcgtgccggaactgcgctggttacaaaggtcgcatttctgtgcaatcgtatcgaccatctcaacgacgccaaaggggcaagcgattgcgcatcttttacaaccaatacatttttgctcgtccagttgtacgctatcggactggaaagtcagagcataaaccggacaagccgtaacgcagggggcattgttgcaatgatggcaggccaccggattcgcagcctggcccttcccaacaatgtggatacggggtcgaaagtcactgtgactcagcggccagttttcttgattgtgtgctaccgcacaggcaatttcacaggcatggcagcctatacattccgcagcttcagcagcgataaacttattcatttgcatccctttcatttaatgagttatgtcttctcaaatttcgcgatgcaataaacgggcatatattaggtagcatgaccgttttaattataattttgcaactgagttcaaattattgcccctcaatctatgccgctttcattatttcaacattgccgatcaaaagaatgctatccagataaaaacgattaaatgcgagagtgcgacatgccagaatgattaatgaaatatcaatatgagaaaattacagataattccattgtcaggttctcttctcattttcgtggtttaaccacgattatgtgattgcctccgcaattcctgtctctaactccccttcctcgcaaaaactggcactccacgagcatgtgtttagacagtttcatgaacgtaaacggttgctttttactctggcgggcgaaaggagaaacactgatgagcgccatagattcccaacttccctcatcttctgggcaagaccgcccaactgatgaggttgaccgcatattatcaccaggaaagctgatcatactcggtctgcaacacgtccttgtcatgtacgcaggtgcagtcgctgttcctcttatgattggtgaccgactcggcctatcaaaagaagctattgcgatgctcattagctcggatctcttttgctgcgggatcgtcacattattgcaatgtatcggtatcggccgctttatggggatccgcctgccggtgattatgtcggtgaccttcgccgctgtaacaccaatgatagccattggtatgaacccggatatcggcctgctggggatattcggtgccactatcgccgcgggttttatcaccacattattagcgccacttatcggtcgcttgatgcctttattcccgccactggttaccggtgtggttattacttctatcgggcttagcatcattcaggtgggtattgactgggccgccggaggtaaagggaatccgcaatatggtaatcccgtttatttaggtatctcctttgccgtcttaatttttatcttgctcattactcgctatgcgaaaggatttatgtccaacgtcgccgtattactggggattgtatttggctttttactttcgtggatgatgaatgaagtcaatttatccgggctacatgatgcttcatggtttgcgattgtcacgccgatgtcatttggtatgccgattttcgatcccgtttccattctgaccatgactgccgtgttaatcatcgtgtttatcgagtcgatggggatgttcctggcactgggtgaaatagtcggtcgtaaactctcttcacacgatattattcgcgggctgcgtgtcgatggtgtagggacaatgataggcggaacgtttaacagcttcccccacacgtcattttctcaaaacgttggcctggttagcgtgacgcgcgttcatagccgctgggtgtgtatttcttcgggaattatattaatcctgtttggcatggtgccaaaaatggcggtgctggtggcctcgattccgcaatttgtgctgggcggcgcggggctggtgatgttcggcatggtactggcgacagggattcgaattctgtcgcgctgtaactacaccactaaccgttacaacctctatattgtggcgatcagtctcggtgttggcatgacgccaacgctctctcacgatttcttttctaagttaccggccgtactgcaaccgttgctgcatagcggcattatgctcgcaacccttagcgccgttgtgctgaacgttttctttaatggctaccagcatcatgctgacctggtgaaggaatccgtctctgataaagatttaaaagtcaggacagtacgtatgtggcttctgatgcgcaagctgaagaaaaatgagcatggagaataatatgaatcttttaatgcgcgctatatttagtctgctgttgatttttactctctctattcctgtcatttctgattgtgttgcaatggccattgaaagtcgcttcaaatatatgatgctgcttttttaaatggtttttacctgtcgacatccgctcaaaatgggcggttgtcgataaacgctcacttggttaatcatttcactcttctattatctataatgatgagtgatcagaattacatgtgagatattatgcaaacggaacacgtcattttattgaatgcacagggagttcccacgggtacgctggaaaagtatgccgcacacacggcagacaccctcttacatctcgcgttttccagttggctgtttaatgccaaagggcaattattagttacccgccgcgcccttagcaaaaaagcatggcctggcatgtggactaactcggtttgtgggcacccacaactgggagaaagcaacgaagaggcggtgatccgccgttgccgttatgagcttggcgtagaaattacgcctcctgaatctatctatcctgactttcgctaccgcgccaccgatccgaatggcattgtggaaaatgaagtgtgtccggtatttgccgcacgcacgaccagtgcgttacagatcaacgatgatgaagtgatggattatcaatggtgtgatttagcagcggttttacgcggtattgatgctacgccgtgggcgttcagtccgtggatggtgatgcaggcgacaaatcgcgaagccagaaaacgattatctgcatttacccagcttaaataaaaaaccccgacggttgccggggttgtgagcataacgtaatgcttattttaccggacgcatcgccgggaacagaataacgtcgcggatggtatggctgttggtgaacagcattaccatacggtcgataccaattcccagacctgctgtcggcggtaagccatgttccagtgcggtgacataatcttcgtcgtagaacatcgcttcgtcgtcacctgcatctttcgcggcaacctgatccaggaagcgctgcgcctgatcttccgcgtcattcagctcgctaaagccgttaccgatttcacgcccaccaatgaagaactcaaagcggtctgtgatttccgggttaacgtcgttacgacgcgccagaggagaaacttctgccggatattcagtaatgaaggtcggctggatcagatgtgcttctgccacttcttcgaagatctcggtaacgatacggcccagaccccagctcttctcaacgtggatgccgatagattcagcaatcgctttcgcagagtcgaagttgtccagatccgccatgtcagtttccgggcgatatttcttgatcgcttcacgcatggtcagtttttcgaacggtttaccgaagtccagcgttacgtcgccgtaggtcacttccgtcttaccgagaatatcctgtgccagagtacggaacagcgattcggtcagctcgataagatctttgtaatctgcgtaagccatatagagttccatcatggtgaactctgggttatgacgtacggaaataccttcgttacggaagttacggttgatttcgaatacacgctcgaagccaccgaccaccagacgcttgaggtacagttccggcgcgatacgcaggtacatgtcgagatccagcgcgttatggtgagtgataaacggacgcgcagcggcaccgccagggatcacctgcatcatcggcgtttcaacttccataaagccgcggttcaccatgaactggcgaataccagagaggatctgcgagcgcactttaaaggtgttgcgggattcatcgttagagatgagatccagataacgctgacgatagcgcgcttcctgatcctgcaagccgtggaatttatccggcaacggacgcagtgctttggtcagcagacgcagctcggtacagtggatagacagttcgccggttttggttttgaacagtttacctttcgcgccgaggatatcgccgaggtcccattttttgaactgctcgttgtaaacgccttccggcagatcgtcacgggcaacgtacaactgaatgcgaccgccaacgtcctgcagggtaacgaaagacgctttacccataatacgacgggtcatcatgcggccagcaacggcgacttcgatgttcagcgcttccagttcttcgttctctttaccgtcgaattctgcgtgcaattggtcagaggtatgatcgcgacggaaatcgttcgggaaggcaatcccctgctcacgcaggttcgccagcttctcacgacgcgttttcagttcattgttaagatcgactaccgcgtcagcgccctgtgcgtgttgttcagacatgttggttcctcataaccctgctttcaaacttgcttcgataaattgatccaggctaccgtccagcacggcctgcgtgttgcgggtttctaccccggtacgcagatctttaatgcgggagtcatcaaggacataagaacgaatctggctgccccagccgatgtcggatttgttatcttccatcgcctgtttctcggcatttttcttctgcatctccagttcataaagcttcgctttcatctgcttcatggcctggtctttgttcttgtgctgggaacggtcgttctggcattgggtcacgatcccggttgggatgtgagtaatacgcaccgcagattcggtacggttaacgtgctgaccgcccgcgccggacgcgcgataaacgtcgatgcgcagatctgccggattgatttcgatatcgatatcatcatcaacttccgggtaaacaaacgctgaactaaacgacgtgtggcgacgaccgccggagtcaaacgggctcttacgcaccaggcggtgaacgccggtttctgtacgcagccagccataagcgtaatcgccggagattttgatcgtcacggatttaatacccgccacttcaccttccgactcttcgatgatttcagttttgaaaccacgcgattcagcccagcgcagatacatacgctcaagcatgctcgcccagtcctgtgcttccgtaccgccagaccccgcctgaatatcgaggtagcagtcggcgctgtcatattcgccagagaacatacggcggaactcaagctgcgccagtttttcttccagggcgtcgagttcagcaacggcttcgttaaaggtttcttcgtcgtcagcttctacagccagttccagcagaccagaaacatcttccagcccctgtttcatttggtcgagggtgtcgacaacggcttcgagggaggaacgctctttacccagcgcctgtgcgcgttcgggttcgttccagacatccggctgttccagctcggcgtttacttcttccagacgctctttcttggcgtcatagtcaaagataccccctaagaacgtcggagcgttccgtgaggtcctgaatgcgattatttaccggattaatttcaaacatggtctgatttcttttattgagctagtcaaaatgcggtgataagagcgggattgtacccaatccacgctcttttttatagagaagatgacgctaaattggccagatattgtcgatgataatttgcaggctgcggttgccgcgaaactcgttgatatcgagcttgtaagccagttgcacttcgcgcacgccgttatccggccagagggcggtatcgacattaaaagcaataccatccagcagcggaccgccgccgaccggctcgaccatgactttcaaatgacgctcgcccaccagccgctgttgcagcagacggaaatgaccgtcaaacagcggctccgggaacatctgcccccacgggccagcatcgcgcagcagctgcgccacttccatggtcatttcggccggacttaacggaccgtccgacaccacttcgccttgcaatagcgaagggtccagccactcagtaaccagttcgccaaaccgttgttgaaagagttcgaatttatcctcttccagcgacaaacccgccgccatcgcatgaccgccaaacttcagcatcatgccggggtaaagcgtgtctagccgctccagcgcatcgcgcatatgcagcccctgaatggagcgaccggaacctttcagcgtaccgtcgcccgcaggcgcaaaggcgataaccggacggtgaaaacgctctttgatacgcgatgccagaatgccaacaacgccctgatgccattcagggtgatacattgccagcccacctggcagcgtgtcgcggctacgttccagcttctcgcacagagtgagcgcttcaacctgcattccctgttcgatctctttacgtgtttggtttagtgcatcgagttcattcgccagcacacgcgcttcgccaatgttgtcacacaacaacagcgccacgccaacggacatatcgtccagtcgcccggcagcattgagacgtggccccagcgcaaaacctaaatcgctggcggcgagtttttgtggatcgcgattggccacttccagcagcgctttaatccccggacggcactttccggcacggatgcgactcatcccctgccaggtcagaatgcgattattagcgtccagcggcacgacgtccgccactgtccccaacgctaccagatccagcagttctgccagattaggaattgcgatgccgcgctcatcaaaccagccctgatcgcgcaaaaaggtgcgcagcgccagcatcagataaaacgccacacccacgcctgccagtgatttcgacgggaaattacagtcgcgcaagttagggttaatgatcgcttccgctgcgggtaatgtgtcgcctggcaaatggtgatcggtaacaataaccggaatgcccaacgaacgagcgtgttcaacccccgcatgggaggaaataccgttatccaccgtgacaattaactgcgcgccacgggcatgagcctgatcgactacttccgggcttaagccgtaaccgtcttcgaaacggtttggaaccaggtagtcgatattgctgcaaccaagcgagcgcatcgccagcacgcttagagccgtgctggtggcaccgtcggcgtcgaaatcaccgaccacaataatccgcgtgccttcgcgaaaagcgttgtaaaggatctcaacggccttttcgacgccgctcagttgctgccagggcagcatgcctttaacactgcgttccagttcctgcgcgctacgcacaccccggctggcatataaacggcgcagcaagggaggcaattcagcgggcaagtcggccgtttcatcgacttctcggcgacgaagttgtatctgttgtttcacgcgaattatttaccgctggtcattttttggtgttcgtcgaggaattctttcatgtctttcggcggctggtaacccggaacaagtgtgccattgctcagcacaactgccggagtaccgctaacgccaagctggacgccaagtgcgtaatggtcggcaatatccacgtcgcagctggctggtgcgacgcttttacctgccatcacatcatcaaacgctttgtttttatctttcgcacaccagatagctttcatttctttctctgcatcgctgtccagcccctggcgcgggaaagcaagataacgcacggtgatccccagcgcgttatagtctgccatttgctcatgcagtttgtggcagtaaccacaggtaatatcagtaaacacggtgatgacgtgtttttcctgcggcgctttataagcgatcatctctttttcaagcgcattcaactgctttaacagcatcttattggtgacattgaccggagccgtgccactaacgtcatacattggcccctgaatgatatgtttaccatcatcggtgatgtacaacacaccgctgttagtcagaactgtcttcatgccagctacgggcgcgggctgaatatcgctgcttttgatgcccattttggctaacgtttgttgaattgccgcgtcatcagcctgaacaaagcctgaaaacgctgccaacaaggtaaataacataaaacctttcttcataaattttcctgttcttttcagacatcacgcccgcgggtgatgctgttgatgaagttgccgcagacgctcggtagcgacatgcgtataaatttgcgtggtggagagatcgctgtggcccagtagcatctgcaccacgcgcaaatccgcaccatgatttaataagtgagtggcaaaagcgtgacgcaacacatgcggtgacagcttttcgctgtcgatacccgccagcacggcataatgtttaatgcggtgccagaaggtctgtcgcgtcatctgctgcgcacgctggctgggaaacaacacgtcaattgacacaccattcaacagccacggacgcccatgttccagataggtttccagccagtaaaccgcctcttcacctaacggcaccaggcgctctttgttgcctttaccaatgacccgcactacgccctgacgcaggctgatatcactcattgtcaacccgaccagttcagagacacgcagtccggtagcatacaacacttcaagcatggctttatcgcgtagctccagtggctgatcaattaatggtgcctgtaataaacgttcgacctgcgcttcgcttaaatcttttggcaaacgctggggcaatttcggtgaagcgagatgcgcactgggatcatcttcacgaaacttttcgcgataaagatactggaacaatcggcgcactgcactcagcaaacgcgctgagctggtggctttatacccgccctccagccgttctgccagtaatgcctgcaaatcgtcactttgcgccgtcgccagcgtcaacccgcggtgatgcaaccactccaccatcattgacagatcgcgacggtaagcgttcaacgtattttcagccagatttttttccagccacagagcatcaagaaactgctcgatgcgtgccagatcctgtttcacttgcgccccttatggtcactcatttgatccattatgccttattgtgccgtgactaaagcgattctgatacactagccgcaaaagccacagcagaatcgagaagcttacgttatgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcattctgggtatcccgacctgggattttggcgaaatccaggaagactgggaagccgtctgggatcagctcgacgacctgaacctcgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcaaagctggtgcgagcaaatcctcaacgaaatggcagagcattacgcctgatgtcactgacggcttagcacatatgctttgccgtcatctttatctttgcgtctcttgttgtaacaatatccgccgtaaatcccgccattcggcttcgtccatgctgtcagctgccagccataaatgttgccgttttccgctgtcagaacgtaaacgcagcatcatgccgctcttaatcatccacggcgctttgacgatgctccactcctgcccttgccaacgcaaacgcccgtccatcaacaagcgaatttccccctggcgagcattaatacgccgctggctgcgaacgcaatcaaacaccaccagcgaaagtaacaccatccataacggggtgtaactgagcggccagggaatgagtaaaataacagcggcaaccagcccatgaatcagcaaggaaagccactgtgcgcgccaggagacgcgcaaatcagattgccacaggaccacgttcccggttccgtgtctggatgagtcggaccatcatttccagttctgcatcggccggtttaccgtgattcatcagccagttaaacaggtccggatcgtcacattccagcagacgaataaagatgcgtttttcgtcatcgcttaagctgtcgtactcatgttcgaaaaacggcatgattgaaatatcgagttcgcgcataccacggcggcatgcccaatgaatgcgggctttgttgttaatgtccatcttcttcctgtctcacgaaaatccagtacccggctattgtaacgtgtttttcgacttcttttacgggaatatcagtaaacataatcgcgatcgcgaaattaattcacaacaattcaagggcttcatttttttggaagtcgcctcgcagaaggcacagatcgcgtagtgaaagcacttgcattgcctcatagctcttttaccattagttattaatacgccgttaagcaactcaggactctattatggcttttacaccttttcctccccgtcagcctacggcttctgcccgtttgccactgacgctgatgacgcttgatgactgggcgcttgccactattactggcgcggacagcgaaaaatatatgcaaggccaggtgacagcagatgtcagccagatgactgaagatcagcacctgctcgccgcccattgcgacgccaaaggtaaaatgtggagcaatttacgtctgttccgcgacggcgatggctttgcatggattgaacggcgcagcgtgcgtgaaccgcagctgactgaactgaaaaaatatgcggtgttctctaaagtgaccatcgcgccagacgacgagcgtgtgctgcttggtgttgccggttttcaggcgcgcgccgcgttggcaaatctctttagtgaactaccttcgagagaaaaacaggtagtcaaagaaggcgcgaccacgttgctatggtttgaacacccggcagaacgtttcctgatcgtaaccgatgaagctactgccaatatgctgaccgataaactgcgcggtgaagcggaactgaacaatagccaacagtggctggcattaaacattgaagcgggttttccggtgattgacgccgccaacagcgggcagtttatcccccaggcgaccaacctccaggcgctgggcggcatcagctttaagaaaggctgctataccggacaagagatggtggcgcgagcaaaattccgtggtgccaacaaacgcgcgctctggttgctgacgggtagcgccagccgactgccggaagcgggtgaagacttagagctgaaaatgggcgagaactggcgtcgtaccggtacggtgctggctgcggtcaaactggaagatggtcaggttgtggtgcaggttgtcatgaataacgatatggaaccggacagcatcttccgcgtgcgtgacgatgcgaatacattgcgtatcgagccactgccatattcgctggaagagtaaatctctgtatcgcatcaggcatttatcgcctgatgcgacactggtgtgtcttttcaggcctacaaaggcacgccaattacgcctgcccaatatacaaatagatcgccagaaagtggcacacactaccgccgagcacaaagccgtgccagatggcatgattgtatggaatgcgcttgcagacgtagaaaatcaccccgagcgaataaaccacaccgcctaccgccagtaaggtaacgctgcccgccgcgagcttaactgccatttcataaattaccaccagcgacagccagcccatcgccagataggtcaccagagataaaattttgaatcggtgcgcgatggtcagtttaaacagaatacccagcaatgccaggctccagataacaatcatcaacccgcgcgctaacggagaatccagccccaccagcaaaaacggcgtataggttccggcaatcaacagataaatggcacagtggtcaaatttcttcagccacatttttgcccgttgatggggaatggcgtgatagagcgtcgaagcgaggaacagcaggatcatactgccgccatagaggctgtaactggttatcgccgtggcgctggcattgagatccaccgcctgaaccagtagcaacaccagcccaacgataccaaacaccagcccaatgccgtgactgacgctgttggcaatttcctctgccagcgaatatccctgcttaatgaggggcttctgaaccataacttactccggaaaaacgtacacgcacatgtatacctctccagcgtaactgagaatagttccagtgaacacctgttagctaaaataaattctgatttgagattaatctccgaaaaatcatgaaattaaatgcgaaatttcaactaacaggcgtgagttcaatttaaagacatttaaattcaatcacataaaactgtgtctggtcgggatagatgtcggcaatgacctttttcagttcagtcagggtcatattttcctgctctgcatgtttttccgtcagcgtatccagcgttacggttgaggttgcggtgacttcaatcgtgcaaaaataaccgtcatcttcaaaacgtccgacacgaagcacatcacccgttttgaagtgcgattcagactcgtcgcggatggtgatggttttacgcccagccagaatgtcatcctggaaacgttgaaaaaaagtgatgtcgtttggctgcatggtactatttcctgtaagaattgactcatctggagcctatgatagtgaaaaaactcaccttaccgaaagatttcttatggggcggcgcagttgccgctcatcaggtcgaaggcggctggaacaaaggcggcaaagggccgagcatttgtgacgttctgaccggtggcgcacacggcgtgccgcgcgaaatcaccaaagaagttgtgcctggcaaatactatccaaaccatgaagccgttgatttttatggtcactacaaggaggacatcaagctatttgccgaaatgggcttcaaatgttttcgtacttccatcgcctggacgcgcatttttccaaaaggcgatgaagctcagccaaacgaagaagggctgaagttctacgatgatatgatcgatgaactgctgaaatacaacatcgaaccggtgatcaccctctcccactttgaaatgccgctgcatctggtgcagcaatatggtagctggaccaaccgtaaagtggttgatttctttgtccgtttcgcggaagtggtatttgaacgctataagcataaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagccgcgcatcgcatcaacccggagatgaaagtcggttgtatgctggcgatggtgccgctctatccttactcctgtaacccggacgatgtgatgtttgcccaggagtcgatgcgcgaacgttacgtctttaccgatgtgcagttgcgtggctattacccgtcctatgtgttgaacgagtgggaacgccgcggatttaacatcaaaatggaagacggcgatctggatgtactgcgcgaaggcacctgcgattatctcggcttcagctattacatgaccaacgcggtgaaggccgaaggcggcaccggcgatgcgatctctggttttgaaggcagcgtaccgaacccgtatgttaaagcgtctgactggggctggcagattgatccggttggtctgcgttacgcgctttgcgagctgtatgagcgttaccagaagccgctgtttattgtcgaaaacggttttggcgcttacgacaaagtggaagatgatggcagcatcaatgacgattaccgcattgactacctgcgcgcccatattgaagagatgaaaaaagcggtgacttacgatggcgtggacctgatgggctacacgccgtggggctgcatcgactgtgtgtcgttcaccaccgggcagtacagcaaacgctacggctttatctatgtgaataaacatgacgacggtactggcgatatgtcgcgttcacgtaagaagagctttaactggtacaaagaggtgattgccagcaacggcgagaatctgtaattagccgatgtgcctgatgtgctccgctcatcaggcctggcactcttttaatatattgagctcgcaatattttatattacgcctcagccgaaacacacaaagcgcactttattaacaagcgaaaaaggcgccgaagcgcctttataagatagtcgaatcagtaaattactggtattcgctaatcggtacgcaggagcagaacaggttacggtcgccgtaaacatcatccagacgtttcacggtcggccagtatttgtctgccacacctgccgggaatactgcaacttcacgactgtacggatgcgcccactcggcgaccagttcgctctgaatgtgcggcgcgttcaccagcgggttatcttccagcggccagacaccggctttcacctggtcaatttctgcgcggatagccagcatcgcatcgataaagcgatccaattccactttgctttcagattcagtcggttcaaccatcagcgtacccgccaccgggaacgacatggtcggcgcgtggaaaccgtagtcgatcaggcgcttggcaatatccagctcgctgatgccggtttcttctttcagcgggcgaatatcgagaatacattcgtgcgccacgcgaccgtcgcgaccggtatacagcaccgggaaggcatcctgcagacggctggcaatatagttggcgttaagaattgccacctggcttgcttttttcagcccttctgcgcccatcatgcggatgtacatccagctgattggcaggatagaggcactaccgaacggtgccgcagaaaccgcgccctgacgggttaacatgccttcgatttgcaccacgctatgacccggtacaaacggagccagatgcgctttcacaccgatcggtcccatacccggaccaccaccgccatgcggaatgcagaaagttttatgcaggttaaggtgggaaacgtccgcaccaataaagcccggcgaagtgatgccaacctgggcgttcatgttcgcgccatcaaggtaaacctgaccgccgaactgatgcacgacttcacacacttcacggatcgtttcttcatacacgccgtgggtggaaggataggtcaccatgatacaggagaggttatcgcccgcctgttccgctttcgcgcgcagatcagtcagatcgatgttgccgtttttatcacacgccacaaccaccacctgcattcctgccatatgcgcggaagccgggttagtgccgtgagcagaggccgggatcaggcagatatcgcgatgcccttcgttgcggctttcatgataatgacgaatcgccagcaggcccgcgtattcgccctgtgcgccagagttcggctgcatacaaacggcgtcgtaaccggtcagtttcaccagccagtcagccaactgcgcaatcatctgctgataaccttcggcctgttccggcgggcagaacgggtgcagttcggcaaattccggccaggtgatcgggatcatctcggcggcggcgttcagtttcatggtgcaggaacccagcgggatcatcgcctgattcagcgccagatctttacgctccagcgagtgcatatagcgcatcatttcggtttcgctgtggtagcgattaaacaccggatgggtgaggatttcgtcgtcgcgcagcatcgcagcctgaatagagcgactgtcgtgagccacgtctttgtccagtgtgtcgatgtccagcccgtggttatcgcccaacagcacgctgaaaagctgcatcacgttttcgcgcgtggttgtttcatcaagggtgatcccaaccgcgttcagaatatcactacgcaggttgatttcacccgcttcggcacgcgccagcacgcccgctttgtcggccacttccacacacaaagtatcgaaatagtgcgcatggcgcagcttcaggcctttttttagcaggcccgccgccaggatatcggtcagacggtggatgcggttagcgatacgtttcaggccaaccggaccgtggtaaacggcatacagactggcaatgtttgccagcagtacctgggaagtacaaatgttggagttcgctttctcacgacgaatatgttgctcgcgagtctgcatcgccatgcgcagagcggtgttaccagctgcatctttcgatacaccgataatacggcccggcattgagcgtttgtattcgtctttcgccgcaaagaatgccgcgtgtgggccaccatagcccatcggtacgccaaagcgttgcgccgaaccaaaaacaatatccgcgccctgtttacccggcgcagttaacagcaccagcgccataatatcggcggcaacgctgaccacaattttgcgtgatttcagttcgctaataagcgcggtgtagtcgtgaatttcaccagtagtgccgacctgctgtaacagcacgccgaagacgtcctgatggtcgagcactttttgcgcgtcatcgacaatcacttcaaaaccaaaggtttcggcacgagtacggaccacatccagcgtttgcggatgaacgtcagaagcaacaaagaagcggttggcatttttcagtttactgacgcgtttcgccatcgccattgcttcggcggcagcggtggcctcatccagaagagaagccgaagccatatccagcccggtcaaatccagcgttacctgctggaagttgagtagtgcttcaaggcggccctgggagacttcaggttgatacggagtatacgcggtataccagcccggattttccagcatgttacgcaggataaccggcggtagctgcacggcggtgtaacccatgccgatgtaagacgtgaagcgtttattgcgactggcaatagccttgagttctgccagtgcggcgtattcggtcgccggtgcgccaacctgcggtggtgtcgcaagctgaatatctttcggcacaatctggccggtcagcgcgtttaacgattgtgcaccaacggcattcagcatttcttgctgttgcgcggcgtccggtccgatatggcgttcaataaaagcgccgctgttttcaagctggcttaacgtctgtgtcatgagcgatggttcctgaaacgtgcagtgaattgtgaacctctctccttgcgaagagagtgagggtgaggcgtaaatttcctcaccctgatcctctcccgcagaagaggaataaagccgttactcgtcttctaacaatgcttcgtatgcggttgcatccagcagtgattccagttcgctttcatcgctggctttgattttgaaaatccagccgcctgcatacggttcgctgttcaccagttccggagaatcgctcagtgcatcgtttaccgccacgatttcaccgcttactggcgcataaatatctgacgccgcttttaccgattcggcaaccgcgcagtcatcgcccgcgctaaccgttgcgcccacttccggtaggtcaacaaacaccatatcgcctaacagctcctgagcgtgttcggtgatgccaacggtgtaagtgccgtcggattctttacgcaaccattcgtgttctttgctgtatttcagttctgctggtacgttgctcatcaatcaatctccaaaaaagtaaatcacgcgacggctttgccgttacgcacaaaaacaggtttcgtcactttaaccggcatttcacggttgcgaatttgcacaatcgccgtttcaccaataccttccggcacgcgcgccagcgcaatgctataacccagcgttggggagaaagtaccgctggtgataatgccttcatgctggttgccctgcgcatcagtaaaacgtaccggcagttcattacgcagcacgcctttttcggtcatcaccagaccaaccagtttttctgtgccatgttcacgctgcgcttccagagcttcacgaccgataaagtcacgatctgccggttcccaggcgatagtccagcccatattggcggctaaaggagaaatagtttcgtccatctcctggctatacaaattcatgcccgcttccagacgcagcgtgtcacgcgcgcccaggccacatggcttaacgccagcttccaccagcgcgcgccagaaatcggccgctttttcattgggcagcgcaatttcgtagcccgcttcaccggtgtaaccggtggtggcaataaacagatcgcccgcctgcacgccaaagaacggtttcatcccttccaccgcctgacgctgggcgtcattaaacagtgtggcagcttttgcctgcgcattcggcccttgtacggcgatcatggaaaggtcatcacgaacagtaatttcgatgccgaaaggttctgcgtgttgggtaatccaggagaggtctttttcgcgggtggcggagttaacaacgaggcggaagaaatcttcagtaaagtagtagacgatgagatcatctatcacaccgccagaggcattcaacatccccgagtaaagggctttgccgcttttggtgagcttcgccacatcgttcgccagcagataacgtagaaactcccgggtgcggctgccgcgaagatcgacgatggtcatatgtgacacatcaaacattccggcatcggtacgtaccgcatgatgttcgtcgatttgcgaaccgtaatgcagcggcatcatccagccgtggaaatccaccatgcgagcgccgcaaagcgtgtgttgttcgtacaaaggagtctgttgtgccatcttgtcctcattgaataagcggggctgacaacttttccatggcgaaattatcaccacgaaacccagcatcggagccactcccggtccccaacgcaatcgttctcttttgcctgaacttaccaccgaaacagactgttaaccataaggtaaaattgatcatcacattagcttatggttaaaaaatgcaaaaatcgcaacagaataaaaaaccaaaaaacacatcagtttctatacaaagatgatttgatgagaaagttaatttgaataagacaatattaagcgctaaaaaaatgtcaaaaaacactaaatcaaaaatccataacattagaaaatataatgcgaaaacggaggttaaattagtttatttcaaatgaggaaaatctcccggcgaaaaaaccgggagatgaaagtgtgatgggtatcaaataaacagcagaagagaaatatttaacgcagccattcaggcaaatcgtttaatcccattgcctgacgaataagttgtggcttaacgccaggaagcgtatcagccagtttcagaccaatatcacgcagcaattttttcgccggattggtaccggaaaacagatcgcggaatccctgcataccagccagcatcagcgccgcactgtgcttacggctacgctcatagcgacgcaggtaaatgtactgcccgatgtctttaccctgacgatgcaaccgtttcagttcagcaatcagctctgcagcatccataaagccgagatttaccccctgccccgccagcgggtgaatagtatgcgcggcgtcgcccaccagcgccagacggtgtgcggcaaactggcgcgcataacgccccgttagcgggaacaccaggcgctcactttcaaccttgcataagcccaggcgattatcaaaagcgatatttaacgcgcgattaaattcgtcttcgcctgcctgctgcatccgctgcgcttcctctggcgacagtgaccagacaatcgagcaaagatgcggatcgctaagcggcaaaaaggccagaatgccttcgccatgaaaaacctgccgcgccaccgcatcatgcggttcttccgtgcgaatggtcgccaccagcgcgtgatgctgataatcccagaaagtcagcggaatatcggctttgttgcgcaaccaggaattagcgccgtccgcgccaatcaccagacgcgccgttaacatgctgccatctttcaacgtcaggaaggtttcattttctccccaggcgacctgctgtaattctgcgggggccaacagagtgatatctgacgactgctgcgctttgttccacagcgcgtagtgaatcactgagttttcaacgatatgcccaagatggttatagcccatgctttgatcgtcaaacgagatgtgaccaaaactgtctttgtcccacacttccataccgtgatagcaactggctctgcgggagagaatctcctgccagacgccaagacgagtcagtaatttttcgctggcggcattgatagccgaaacgcgcagttgtggtggtgcatccgccgccagaggttccggtacgcgctgctccagtacggcaacgcgtaagccgctaccctgtaagccgcaggcaaccgccagcccgaccatgccgccgccaacaatggctacatcaacactttgcattgtttattccttaaaaccgccttcaacgcgccacccaaccaagagtgcgctgcgccagcacatcgcgtgccggggtaaataattccatcgtcatcagcccgatgttgcgcccgacaaccagcggcgtccaacggttggcaaaaagatgtacaaggctgtccgtgacgccgatggttgcttcgcgatcgctctgtcgacgctgctgataacggcacaatacgccgtaatcacccatgtcttctccgcgttcctgcgcctgagtcagggtttccgcaaggctcatgacatcacgcataccgaggttaaatccttgcccggcgatgggatgcagagtttgcgccgcattgcccaccagcacggtacgatgggtaataggtttggcggcgcgggttagcgctagcggataagcactgcgtttaccggcatgagtaattttcccaagtcgccagccaaaggccgactggagttcacggcaaaacttctcgtcgctccacgacagcacctcttcgcgccgttccagtggatgacaccagaccagcgaacagcgtccgtcagacatcggcaacatcgccagcgggccatgtttcgtgaagcgttcaaaagcgcggccttcgtgcgcaacggaagtcgcaacgttagcaatcacagccagttgttcgtaaggctcctgctgccagtcaacgccgcacacagtggctaacgctgaatgggtgccatcagcggctaccagcacgcagcccgtcagcgtctcgccactctccagcgtcacttcaacgaggctctgagtacgggcaacgttagccacgcgatcagggcaatgcagcgttacgccaggtgctttgcgcagcaatgcaaacagccgttgcccgacattgtgcaattcgacaacctgccccagcgccgccagttggtaatcttctgcggcgagggtgacaaatccagcgtgaccacgatcgctgacatgcactgtggtgatggcagttgcgcaatcagccagagattgccagacgccgatgcgcgccagttgctgacaagtacccgccgccagcgcaatagcccgtccatcaaagcccggatgagcatgtgactctggcgcagtcgcttcaatcaaatgtaccggcagcgccccgtgacttaaccgggaaatagccagcgccagcgtcgcgcccgccatgccgccaccgacgatgattacgctcattgctttctcgcagcagccatcaacgcttcgatttcttccggctttttcaccacgctggcggtgaggttttcgttgccggtttcggtaatcacaatgtcgtcttcaatacgaatgccgataccgcgatactgttctggcacgtctgcatccggcgcaatataaagacctggctctacggtcagaaccatgcccggttcaagaatgcgcgagcgctcctggccataaacgccaacgtcatgaacatccagacctaaccagtggctaaggccatgcataaagaaaggacgatgggcattctgagcgatcagttcatcaacatcacctttcaggatgccgagttttaccaggccgctaaccatgatgcgcaccacttcaccagtgacttcctgaatggaagttcccggacgatacaggcgcaagctggtttcgagagattccagcacaatatcgtagatttcacgctgggcctgggtgaatttgccgttgactgggaaggttcgggtaatatcacccgcgtaacctttgtattcgcaacccgcgtcaatcaacaccagatcgccgtcgcgcagttcacactcgttttcggtgtagtgcaaaatgcagccgttttcaccgctgccgacaatggtgttataggaagggtaacgcgcaccgtggcggttaaattcgtggtgaatttcgccttccagatggtactcgaacatccccggacggcatttttccatcgcccgtgtatgtgccagggcggtgatttctcccgcgcggcggagtacggcaatctcttctggcgatttgaacaggcgcatttcatggaccatgggacgccagtcgatcatcgttgctggcgcggtgagattttgtcgcgagcctttacgcagtttttccagtgcactgttcacgatttcatcagcatatgcatattcgccctgagcatggtaaaccacatccaggccgttaagtagttgataaagttgctgattgatttcgctgaatgccagtgcgcggtcaacacccagtttctctggcgcggcatcctggcctaagcgacgaccaaaccagatctctgccgtcaggtcgcgaacgcggttaaacaaaacgctgtggttatgagtgtcgtcgcttttaatcagcaccagcaccgcttccggttcgttaaagccggtgaagtaccagaagtcactgttctgacgataggggtattcgctgtcggcgctacgtgttacttctggtgcagcaaaaatcagcgcggcgctgccgggttgcatttgctctaccagggcctgacggcgacgctgaaattcttgccgggatatatcactcataacactctccttacgttttttgtttttagtgtagagtcggtttttgtacttctggcgcagtcggttgcggatgagtaaaggtgtcgtggcataacagcgcggcaacacggacgtactcgatgatctcttcaagcgacatttcaagctcttcctgatcttcgtcttcgtcgtaacccaactgtgcgatgttacgcagatcgtcgatggcttcaccggtttcgccggtcactttgtccagcttcggttgcgtaacgccaagaccaagcaggaagtgattaacccaacctgccagcgcatcagcccgatcgaaaacgctgacgtcatcgccatcaggcagataaagctgaaaaaggaagccgtcatcctgcagggcatcgctggtggcagagtgcattttgcgcagtgcctgtgccagctcatgaccgaaagccatgccttcgttcgtcaggtcgtgaagtagcggcagccatgagctgtcatcgttaccgccacatatcatcccactgattaaaccatgcatctcagcaggggtcagacccgtcccttgttggttcagatactggttcatttcgttgtaaccaggcatttcgttctgtatagacataagcattcgtcgtcaaagggaggaatattcatgatatgctaccactttgggccctggtggaccagaaaagggcttgtctcttctcatcagggtagctatagtgtcgccccttcgcagaccatgggtctaaagacgaaggcagcgcagtcaatcagcaggaaggtggcatgtctgcacaacccgtcgatatccaaatttttggccgttcactgcgtgtgaactgcccgcctgaccaaagggatgcgttgaatcaggcagcggacgatctgaaccaacggttgcaagatctgaaagaacgcactagagtcacaaatactgaacagttggtcttcattgccgcattgaatatcagctatgagttagcgcaagaaaaagcgaagactcgtgactacgcggcaagtatggaacagcgtattcggatgctgcagcagaccatagaacaagcgttacttgaacaaggtcgcatcaccgaaaaaactaaccaaaactttgaatgacacttttcggtttactgtggtagagtaaccgtgaagacaaaatttctctgagatgttcgcaagcgggccagtcccctgagccgatatttcataccacaagaatgtggcgctccgcggttggtgagcatgctcggtccgtccgagaagccttaaaactgcgacgacacattcaccttgaaccaagggttcaagggttacagcctgcggcggcatctcggagattcccttcttatctggcaccagccatgacgcaactaccagaactcccactgacattatcccgacaagaaatccgcaaaatgattcggcaacgtcgtcgtgcgttaacgccggaacaacagcaggaaatgggtcaacaagccgctacccggatgatgacttatcccccggtggtgatggcacatacggtcgctgtattcctctcttttgatggcgaactcgacacccagccactcatagaacaactctggcgcgccggtaagcgcgtatatcttccagttttgcatccctttagtgccggtaacttgctgttcctgaattaccatccgcaaagcgaactggtgatgaacaggttgaagatccatgagccaaaactggatgtgcgtgacgtgctacccctttcccgattagacgtgttgatcacaccgctggtcgcctttgatgagtacggtcagcgcctgggaatgggcggtggtttttatgatcggaccttacaaaactggcagcactataaaatgcaaccggtgggttatgcgcatgattgtcagttggtggaaaaactccccgttgaagagtgggatatccctcttcctgcggtggttacaccgtcgaaagtctgggagtggtaagggcgacacacctgcatcgccctgattgacatcgttgattctttaacctaatttagtgagtaagggtaagggaggatgactcctcccctgagactgactgttaataagctgggaaacttatgagtaacagtacaatcagtatgatgacaagtcgcatcataacccttctccttcaagccctcgcttcggtgagggctttaccgttacagccccatgctgccctgccatcgtaaatccccattaaataaacacaacgcattgatctgactttgatttattttctggagcagactcgcaatgtagaatgcgcaatgcggcaacggtgtggagaagggataaaaaaaacgggcaagtcagtgacctgcccgttgattttcagagaaggggatttagtacagcagacgagcgcgaatggtacccggaatagctttcattgcctgcagcgctttttcggcaacgtcttcgtcggcttcaatatcaataactacataacccatctgggcggaagtttgcagatattgcgcggcgatgttgacgccctgctcggcaaaaattttgttgagcgcagtcagcacacccggacggttttcgtggatgtgcatcagacgacgaccaccgtgcagtggcagcgagacttccgggaagttcaccgcagagagcgttgaaccattatcagaatacttgatcaatttacccgcaacttccagaccgatattctcctgcgcttcctgagtcgaaccgccaatgtgtggcgtcagaaggacattgtcgaattcacacagcggagaggtaaatggatcgctattggtcgccggttccgtcgggaatacgtcgattgccgcccccgccagatgtttgctcgccagcgcgtcacacagcgctggaatatccaccacagtaccgcgcgaagcattaatcagcagcgagccgggtttcattagcgaaatctctttcgtgcccatcatatttttggtggacggattctctggtacatgcagactcaccacatcgctcatattcagcaggtcagaaagatgctgtacctgagtggcgttgcccagcggcagtttgttttcaatatcataaaagtaaacatacattcccagcgattcagccagaatgcccaattgcgtaccaatatgaccgtagccgatgatacccagctttttgccgcgcgcttcaaaagaacccgccgccagtttgttccacacgccacgatgcgctttagcattggcttccggcacgccgcgcaatagcagcagcagttcgccaatcaccagctccgcaacagagcgcgtatttgagaacggtgcgttaaataccgggatcccgcgctttgccgccgcatccagatcaacctggtttgttcctatacagaaacagccaatagcgaccagtttttctgcggcgttgatcacgtcttcagtcagatgggtacgggatcgcaggccgatgaagtgggcatcgcggatggattcttttaattgttcatcatccagcgcgcctttgtgaaattcgatgttggtgtaaccagctgcacgaaggctttccagcgccttttggtgcacgccttctaccagcagaaacttaatcttgtctttctccagcgatacctttgccatttacccaatcctgtcttttgaaatgttgtgtgcggatttgcatccgcctttcaacatatcaaaaaataatattgcggcaatatgaacgtttgcgtcgcgatgttgaggaaatatcacgcaaaagtatttcttggatgaatatgctggtttagaagatttatttagagcaatcgacaattgccaggtaaaaacgtgacacatgtcactaaatttaatgaagagaatttttttaacgggggaggttcccccgtcagatcatttcacaatagttttgacaccgtcaggtgtgccaatcagcgcaacgtccgcgccacggttagcaaacaaaccaacagtcaccacgccaggaatcgcatttatggcgttttccatcgctatcgggtcaaggatttccatgccgtggacgtcgaggatcacgttgccgttatcggtcactacgccctgacggtattccggacgaccgcccagtttcaccagctggcgcgccactgcactacgtgccatcgggataacttctactggcagcgggaatttgcccagaatatcaacctgcttggaagcgtctgcaatacagataaatttttccgcaaccgaagcaatgattttttcacgggtcagcgccgcgccgccgcctttgatcatttgcatgtggccgttgatttcatctgcgccatcaacgtagatgccaaggctgtcgacttcgttgagatcaaaaacgtgaatgccgaggcttttcagtttttcagtggaagcatctgaactggaaacggccccttcaatctggcctttcattgtaccgagtgcgttaataaagtgtgcggcggtggaacctgtacctacaccaacaatggtgccgggctgaacatactgaagtgccgcccatcctactgcttttttcaattcatcctgcgtcatgatcgtttcgcctgtggtatgaaatttcacacgcattatatacaaaaaaagcgattcagaccccgttggcaagccgcgtggttaactcatccataaaatatcgcgcaatggcgggcatcccctttcgccccgcaagtaaagcatacaacggtctgggtatgccgctccacggtgcaaacaggcgcaccagttccccgttcgcaagcccctgtttacaggcaaactgaggcaataacgccacgccattcaacacaaccagggcgcgaactcgctgagcgaaatgcattagcgcaaatccctgatcttttaagctgcgcgttaaccactgatacaaatgttacccaccaacggcttcggtatatgcaacccgacacaaaattgtgtcatagtgcaggaaaaagcatttaccaggagcagacaacagcaatgaaacgcccggactacagaacattacaggcactggatgcggtgatacgtgaacgaggatttgagcgcgcggcacaaaagctgtgcattacacaatcagccgtctcacagcgcattaagcaactggaaaatatgttcgggcagccgttgttagtgcgtaccgtaccgccgcgcccgacggaacaagggcaaaaactgttggcgctactacgccaggtggagctgctggaagaagagtggctgggcgatgaacaaaccggttcgactccgctgctgctttcactggcggtcaacgccgacagtctggcgacgtggttgcttccggcactggctcctgtgttggctgattcgcccatccgcctcaacttgcaggtagaagatgaaacccgcactcaggaacgtctgcgtcgcggcgaagtggtcggcgcagtgagtattcaacatcaggcgctgccgagttgtcttgtcgataaactcggtgcgctcgactatctgttcgtcagctcaaaaccgtttgccgaaaaatatttccctaacggcgtaacgcgttcggcattactgaaagcgccagtggtcgcgtttgaccatcttgacgatatgcaccaggcctttttgcagcaaaatttcgatctgcctcctggcagcgtaccctgccatatcgttaattcttcggaagcgttcgtgcaacttgctcgtcagggcaccacctgctgtatgatcccgcacctgcaaatcgagaaagagctggccagcggcgaactgattgacttaacgccagggctatttcaacgccggatgctctactggcaccgctttgctcctgaaagccgcatgatgcgtaaagtcactgatgcgttgctcgattatggtcacaaagttcttcgtcaggattaatccatcaaataacgcctgatagcacatatcaggcgttatcctcacttctttttgtattccttgaatcacatcacaaaatagacaaatctcaggcggcaaaaaacgacgtctgaatgcatttttttgctggcgacaaacccacgtaaaaagctcaccgtaagcgcaaataccctcattttgattgcgttttatggagcaaataatgtctaacgtgcaggagtggcaacagcttgccaacaaggaattgagccgtcgggagaaaactgtcgactcgctggttcagcaaaccgcggaagggatcgctatcaagccgctgtataccgaagccgatctcgataatctggaggtgacgggtactcttcctggtttgccaccctacgttcgtggcccgcgtgccactatgtataccgcccaaccgtggaccatccgtcagtatgctggtttctcgacagcaaaagagtccaacgctttttatcgccgtaacctggccgccgggcaaaaaggtctttccgttgcgtttgaccttgccgcccaccgaggctacgactccgataacccacgcgtggcgggcgacgtcggccaagcgggcgtcgctatcgacaccgtggaagatatgaaagtcctgttcgaccagatcccgctggataaaatgtcggtttctatgaccatgaatggcgcagtgctaccagtactggcgttttatatcgtcgccgcagaagagcaaggtgttacatccgataaactgaccggcaccattcagaacgctatcctcaaagagtacctctgccgcaatacctatatttacccgccaaaaccgtcaatgcgtattatcgcagacatcatcgcctggtgttccggcaacatgccgcgatttaataccatcagtatcagcagttaccacatgggtgaagcgggtgccaactgcgtgcagcaggtagcatttacgctcgccgataggattgagtacatcaaagcagcaatctccgccgggctgaaaattgatgacttcgtccctcgcctgtcgtttttcttcggcattggcatagatctgtttatgaacgccgccatgttgcgtgcggcacgttatttatggagcgaagcggtcagtggatttggcgcacaggatccgtataacaacgttatccgcaccaccattgatcattgtgcacatcctatgtgtcgggattatctgcatcgctatctggaaaatgcgtccggcggacatattcaccacgatcttagccacgtcttcgacttacaccgtaatttaattgcaaccggatcgatgctgggttaatggtttgtcccgtcacgatcttcagcaatatgctgaagcatcgtggcggtataacgatgatttctgattgaataaagatattcctgcatatacatcggcctgtgcggcgcatcaaaatatttcagcgttgtcggattcaccagtcgccaggcaaaatgcgggatcaccgtcagaaaatgtccccgctccacggcgctgattttggccataaaactgtagggacgataaataatggttggattgatcccacaaggacgcatattcgcatcaatcattgtttcgaaattggcccgattctgaaagcgcatttgtagccagggcagctcctgaagcagctcttgctcttgtcgctcttcataacggcgagaaacgagaaagcccaatcgcagcggcggtagttcactgatagtcaggttttccagttcctgaactcgtgcagatacatgctgtggggagattataaaatctaactgacggtcaaaaagattatcgataacgccattttcgctgaactcaactggctgggcggtcacgccttcgtacttatctccgagactaatcaactgatcaaaaataatggtcggataagtattatctatgcctatcacaatgtctcgtgaacgacgtcctgagttatggatttcattatcaatcgcagaaagtcgttgataaaccgggaacagtttttgatacagttcctgtccggctttattgaggctgatattattatctttgcgggtaaatagcgtatagccaatttgttcttccagcgcggcaatgcttttgccaaatcgcgaagccgtcatatggattttttctgccgcccgggcaatattattggtttgcgctaataaaatgaaattgcgcatctttttcgaaataaaaatgtccatcccccctctcccgcatccttgtccgcttaaccgtttcagtcagcctatccttgatgaaaccgcgagcaaagataggtgattacgtcatggttttacagaaaaaggaggcaatatcgggtaaaggcattagcccgacgaatacgtcaggctacaagtattaatgtgcagcaggtgttttagcggggggttgatccacaggttctaactggaagaccacatcgacctgatcatcaaactgaatagcggcctgctcgtaagtttcctgggcggacaccggcgcggcatcggctttcatcatccgcaccattgggctgggctgatagttggaaacatggtagcgcacgctatataccggccccagtttacgatgaaagccgttcgccagttcctgcgcctgatgaatcgcgttatcaatcgctgccttacgcgctttgtctttataggcatccggctgcgccacgcccagcgacacagaacgaatttcgttaagtcccgccttcagcgcgccatccagcaaggaattcagtttgtctaactgacggagcgtgacttccaccgttctcacagcacggtagcctttcaggatacttttaccatcctgataatcataatctggctgggtgcgtaagttcgctgagctgatatcttttttcgcgatctgattgagttcaaggaaggaaatgtattgtgcgacgcgctcatccgcctgtttcttggcagtagcggcatccttcgcggccacgttaacttcaatcgcaagagtggcaatgtctggcaccgcatccacgcttgccgtaccggaggtgacaatatgcggtccatccggcaattcgttagcctgcgctgccatcccgctaatacccattaatgccgccagggcgataactttgaacttcacgttagtctctccgtgttaattgacttgcccaaaattcaggacctctggaggcaagcttagcgcctctgttttatttttccatcagatagcgcctaactgaacaaggcttgtgcatgagcaataccgtctctcgccagctgcaaggcaataaaccacataacacatcccactaccagattgataatgcgctgtgattttgccgtgcgcaggcacggtgccagccaggctgcgagaatagccagaccaaagaaccacaggaaagaggcgctaattgttccgagcgcaaaccaacgttttggttccacatcaagttgcccgccaaggctgcccagcacaacaaaagtatccaggtaaacatgcggattcagccaggtcactgccaacatggtggcgataattttccatctgccttgtttcaggacttcggcactggctaactcaatgttactgctcattgctgttttaaaagcgccaaaaccataccacagcaagaaggctacgccgccccaggtgaccagcgccagcaaccacggcgactgcatcaataacgcgctgccaccaaaaatccccgcacaaatcaggaccaaatcgctgatagcacaaagtaaggcaatcataatgtggtactgacgacgaatgccctgattcatcacaaaagcattttgtggaccgagcggtaggatcatagctgcgccaagtgcaagaccttgaaagtaataagaaaacacgttggatattccgaattaagtatctgatgcagagactatatcgcgggattgttattagcggaaattgataatattaattggcaatcagaaaaactaataagagagaggccagagagtattatctggcctcagcgttgattacgcagctttgtcttctttcacccgcttaaagttcacatccatttgcgggtacgggaagctgataccggcggcatcaaattcacgtttaatacgctccagcacatcccagtacacgttttgcagatcgccgctgttgctccagacgcggaccacgaaattaatcgacgatgcgccaagttcgttcagacgcacagtcatttcgcgatctttcaaaatgcgatcttcagactggataatatcggtcaggatctgcttaacctgatcgatatcggaatcatacgccacgccaataataaattcgttacggcgagctggctcgcgggagaagttaataatattcccggcaataattttaccgttcggaataacgataattttaccgtctgcagtacgcatggtggtggagaaaatctgcacactcagcacagtaccggctacgccgccgaggtcaacatattctccggcacggaacgggcggaacatgacaagtaacacgccagcggccaggttagacagtgacccctgcaaagccagaccaacagctaagcctgcggcaccgagtacagcaatgactgacgctgtttgtacgcccacgcgccccagtgcagcgattagcgtaaaggcgataattccgtaacggactaatgcagaaagaaaatcagcaacagtggcatcgattttacgggagatcatcaggcgattcaccgcgttggaaatcatccgcgcgataatcaaaccaacgatgatgatcgcgagtgccgccacgatgtttactgcataacttagcagcagcgcctggttagccaccagccagcttcccgcgccgtttatgctatcgacaacattcaaatcttccattcaatattccttttcaactgactcaaaatggagaaatacactccgccgccttatgacgggcagtctgacaagggtaaacaataaagcataattttgccaaatagatcacagatttctcatctgtatcaccttgcttttggcgaaaaaaagacccgcagagcgggccttgagataagcagaaaggaatatcttacagaacgtcgatcgcgttcagttcctggaatgctttttccagacgagcgatcatcgaagtctgaccggcacgcagccatacgcgcggatcgtagtatttcttgttcggctgatcttcgcctttcgggttgcccagctggccttgcaggtaagcttcgttttctttgtagtagttcagaacaccttcccaggttgcccattgggtatcggtatcgatgttcattttcactacgccgtagcttacggagtctttgatttcctgagcagtagaaccggaaccaccgtggaagacgaagttcaggctgttgtgcggcaggttgtgtttcttagaaacatattcctgagagtcgcgcaggatggtcggagtcagaaccacgttacccggcttgtaaacaccgtgtacgttaccgaaggacgcagcgatggtgaaacgcgggctgattttgctcagctcggtgtatgcgtaatcaacgtcttccggctgggtgtacagtgcagaagcgtccatgtggctgttgtccacgccgtcttcttcaccaccggtgcaacccagttcgatttccagagtcatgccgattttggacatgcgctccaggtatttagagcagatttcaatgttctcttgcagagattcttcagacaggtcaatcatgtgagaagagaacagcggcttaccggtagcagcgaagtgtttttcacccgcgtccagcagaccgtcgatccacggcagcagtttcttcgcgcagtggtcggtgtgcaggataaccggaacaccataatgttcagccatctggtgaacgtgatgcgcaccagagatcgcacccaggatagcagcgccctgcggaacgtcagatttcacgcctttaccagcgataaaagaagcaccaccgttggagaactgaacgataaccggcgctttaactttagctgcggtttccagtacggcgttgatggagtcagtaccgacgcagtttactgctggcagtgcgaagttgttttcttttgctacctggaaaactttctgtacgtcatcaccagtgattacgccaggttttacgaaatcaaaaatcttagacatgtctcttgtcctgtatcgtcgggccttatactcgtcatacttcaagttgcatgtgctgcgtctacgttcgctcaccccaatcacttacttatgtaagctcctggggattcactctcttgtcgccttcctgcaactcgaattatttagagtatgaaaaagtgcgtgctctaaaagcgcgctgaaacaagggcaggtttccctgccctgtgattttttacttcttagcgcgctcttcgagcatcgctactgcaggcagtactttaccttctacgaattcgaggaatgcgccgccgccagtggagatgtaggagattttgtcagcaatgccgaacaggtcgattgctgccagagtgtcgccgccgccagcgatggagaacgcttcgctgtctgcgatagcgttagccacgatttcagtacctttgcggaagttcgggaattcgaacacgccaaccggaccgttccacagaatggttttcgcattcttcaggatttcagccagttcctgagcggaagcatcaccgatatccaggatctgctcgtcagctttcacatcgttaacagatttcagggtagccggtgcagtttcagagaactcggttgctacgcgaacatcagacggaaccgggatgttgcaggtggtcagcagacgtttagcttcgtcaaccaggtcagcttcgtacagggatttacccacatcgtggccttgtgccgcgataaaggtgttagcgataccaccgccaacgatcagctggtcagcgattttagacagggagtccagaacggtcagtttggtagatactttagaaccaccaacgatagccaccatcgggcgagcaggttctttcagtgctttacccagcgcgtccagttcagctgccagcagcgggcctgcgcacgcaacgtcagcgaatttaccgataccgtgagtagaagcctgcgcgcggtgagcagtaccgaatgcgtccattacgaacacgtcacacagtgcagcgtattttttggacagagtttcgtcatctttcttctcgcctttgttgaagcgaacgttttccagaacaaccagttcaccttcagcaacgtcaacgccgtcgaggtaatctttaaccagacgaaccgggttagacagtttgtctttcaggtagttaacaaccggcagcagagagaattcttcgttgtactcgccttcggtaggacgacccaggtgggaagttaccatcacttttgcgccttgtttcagggccagttcgatggtcggcagagaagcacggatacgcgcgtcgctagttactttcccgtcttttactggtacgttcagatccgcacggataaatacacgtttcccagcaagatccagatcggtcatcttaattacagacatggtgaatcctctcgttgattctaaaagttttgcagacgctgcttgcgtcttacctgaaagcaacagtagccatagctaacgtcgtgtcgagcattcggttagcaaagccccattcgttatcgcaccagaccaacgttttgatcaggtgtgcgccactgacccgggtttgagtgccatcgacaatggcactgtgcggatcgtggttaaaatctacagagaccaacggcaattccgtatagtcaactataccatgaaatgcaccttgtgctgctttttgcagcaacaggttgacttcattggcttttacaggtttcttcaccgtcacgcttaaatcgattgccgtcacatttatggttggcacacgtaccgcaatcgcctcaaagcgatcgttaaattgcggaaaaaatcgtgtgataccggcggccagtttagtatcgaccggaatgatcgactgactggctgcccgagtgcgacgcaggtctggatggtatgcatcaataacctgttgatcgtgcatggcggagtgaattgtggtcacagtgccggactcaataccgtacgcatcatctaacaatttgatgacgggaattatgcaattcgtggtacaggaagcgttagaaacgatgcggtgttccgcacgaagttgatcctgattgacgccataaacaacggtcgcgtcgagatcgttactgccaggatgtgaaaagagcacttttttagccccggcggcaatgtgtgcttcaccatgctcgcgggagccatatacgccggtgcagtcgaggactacatcaacgccaagttcacgccaggggagcgattgcagtgaacgttcatgcaatacacggatggcgtcatcaccaacaaaaagttgatcgcgttcctgtcgtacttcccatgcaaaacggccatggctggtgtcatatttcaacaaatgcgccatacccgcagcatccgccagttcgttgattgccaccacggtaatttccgcacggcgtccggattcatacaaagcacgaaccacattacgcccgatgcgaccgaagccatttatcgctacgcgtacggtcatagatctcctgcaaggttttccctgagcaaatttgccagacagagtaatccagcaaatcgttcggggaaaccttacctgtcgcaaactgcgactgattggttaattgtcgaacatttaatcgactgaaacgcttcagctaggataagcgaaacgtggaataaaaggaatgattgtccagtcaaagaagacaattatctgacttacgtcacgttttcagccccgcccctgcggaatttattccactttgcagaatcacgaataagcgtagcaaaatcttttcgttgtgccgtcacaaaccctgacttatatcagaatatgactgatgcagcgtcgatattatccgcaatacgtccgagtttcggagtactccaatgatgacattgccctacccatattcttcctccgcacgtttttacgcgctgcgcctgctccccgggcaggaagttctctcccaattacgcgccttcgcgcaacaacaacaacaacaactccacgccgcgtggattgcaggttgtaccggcagtctgactgacgtcgccttacgctatgccgggcaagaaaacactgccctgctaagcggtaagttcgaagtcatcgcattgaacggcacgctggaacagagtggtgaacatcttcatctctgcgtttccgatccacacggcacgatgcttggcggtcatatgatgcccggctgtaccgtgcggaccacgcttgaactggtgatcggctgccttgaggaactggcgtttagccgccagtcttgcgcgctttctggttacgacgagttgcatatttccccccgttaaataactactttcagtgaggttttcttatggcgcgtcgccacttttccagtcaggcattggtgttgatcgttatctctatcgccatcaatatgatcggcgggcaactggccagcatggtcaaattacctatttttctcgactccatcggcacacttattagcgcggtactgcttggtccggtgatcgggatgctgaccggtttactgaccaatttactctggggattgctgaccgacccgatcgccgccgcatttgcgcccgtcgcgatggtcatcggcctggtcgccggttggctggcgcgagcgggttggtttcgcaccctgccaaaagtcgttgttagcggcgtgattattacgcttgcggtaacggtcgtcgctgtaccgctgcgtactgcgctgttcggcggcgtgacaggaagcggagccgatttgttcgttgcctggatgcactcgatggggcaaaacctggtggagtcggtggcgattacggtgataggcgcgaacctggtcgataaaattctcacagcggtgattgtctggcttttactgcgtcagctgccgattcgcaccacgcgccattttccggcaatggctgccgtgcgctaaatgcatccgtttacatccttaacgctgtgggcgctggcggcctgcaccacgcttatcctgcccacacagacaatattgccagtctatagcgcggcgacctttttctgccttattgcgctaaaggccacgcggcggcgggcaaaatatgtcgtctggctgatgttctcgctgggggctggattgtggctggtgcacggtggctggctgacagaatggctaagcggcacgccacgctctccagaacggtgggcgcatgctattacgctctggttgcggattctggcgattgtttcaacctcacagttgtggatgcagtacgtccccgtgcaacgttttatccgcgctttgtttgcttctcgcctgccgccgggcgtcgcttatctgtttgccgggccgttattggtcgttgagcagttaaaacggcaattggcgattattcatgaagcgcagcgcgcccgcggcgtgccgctggatgagggctggtatcagcgtttacgtgcgatgcccgcgttaattattccgctaacacacaatgcgctaaacgatcttgctgtccgtggtgcggcgctggatatgcgggcatttcgaatcaacaataggcgcactacgttatgggcaccagccgatagcaccctacaacgcgtagcacgttacaccatgatattgctaatgctggctgaattcggagcgtggatatggttacgttagaacagtttcgctattgcccgacacactcaacgcatcctccgttctgttatgactttcactatgtcaaaccggggatggtcgccatctttggtgacaacggcagtggcaaaagtacgctggcgcagctgatggcgggctggtatccggactttctaccaggagagataaccggcacggggacgcttctcggtacgcccattgggcgtctcccgcttaatgaacaatccgccaccatccagctcgtccagcaatcgccctatttgcagctctccggctgtacctttagcgtggaagaagaagttgcctttgggccagaaaatctgtgtcttgctgaaaaagagattatggcgcggattgacgccgccctggccctgaccgagtgccagccgttgcgccatcgtcacccggcaacactctccggtggagagacacagcgtgtggtcatcgcctgcgccatcgcgatgcagccaaagctcttaattcttgatgaagcctttagccgcctgacgccgcaggcccgcgaaatgctgttgcagcgcttacaacactgggcgcttgaacgtggttcgctgattattctttttgaacgtcatcacacacctttcctgaaccactgccagcaagcgtggcaattgcaaaacggagcgctccagccactatgttaacgttaaatcagatatcttatcgctggcctggcgcggcaacggattgtctttgcgacatttctctgcaactcaaacaaggtgaatggttggcgctgaccggcgacaatggcgcgggaaaatcgacgctgttacgagtaatggcaggtcttcttacgcccacagccggtacggttatgctgcaacaacaagcgatgaaaaacctgaaaaaccgccagcgcgcggcaaagattggcgtactgtttcaggacgcggaaaaccagctttttcacagcactgttgctgacgagatcgcatttggtttgaaactgcaaaaatgcccggcggatgaaatcactcaacgtaccaatgctgccctgcaatgctgccagttagcagacactgccagcgcgcatccgttagatctgcatagtgcgcagcgacggatggtcgccgtcgccagcctggaagcactctctccacccctattgctactggacgagccgagtcgggattttgacgaaaattggttgagcgtgtttgaaagctggctggaaaagtgccgccagcgaggcacgagcgtcgtagcaatcagtcatgacgccgcatttacccggcgtcatttctctcgtgtggtgcgactggaagatggtgtaatcaggaacgttaatccatcagacgatattcacccgtagcggtcatcattaaggtcaaatttgcaggcagactctcttccagcacccggcgaacattcggcccgtcggtacggtcataaaaggcttctgcgtctgccagcgataaccctcccgccagcttgcgccccaccagacgctcccgcaacgcagatgcgggagctttgataaagatcgagaaatcacaaaattgcgcaagctggcaccacttctcgtcgtccagcaacaaccagtttccttcgacgatgacgagtggtgcggtaacgtgcagcgcatcttcaacaggatcatgcttttgtcgatcgtactgcggccacgtacaatccccttccacaacccggcacagattttccgccagtttcgcaacgttgaatgtctctggtgcgcctttgaaggggcgcaattgatgcgcatccagccagctattgtaatggtgaaaaccatccatcggcagtgtctgaatagcgggcagttccgggtcttgttgtgcgagatattcccagaaggtggttagggtagatttacccgtccccggcggagcgcaaagaaaaaccaccgtacgccgctgcggatttactgtctgtaaggccgccagcatacgcagcaacggtttatgtacattttcaatctcttcgttctggtactgtgcctgtatcttcagcccattcaccgttaattcaattttcacggcgttaattcctttaaggttgtcgttactgccagcgtcagcgccgttttgaccatcccgctaaaacgcgcctctgaccagacggcgaaatcggcgaacttcatcgctttcaacgcgtcatagagcgtcgcattgcgggttatgctattgacgttgctgataaaatcccaggccatgtcatcggcaaatccgggcatttcattctgttcgttcaggtaatgccagaactgggaaaaatgcgtgatatcggcgtacagccatttatccattttccccagcgcataaatcaaacgcagcgcaacatcaatatcgtcaagcgggccgctttgggcgagtaacggcttcactgcatattcgacgatctcttcatcgttatcgacaaacagcgacggcagaaactggcgtatcccctggagcaaaatagaatgcgcagttttcataaatgaaaataaattgtcctgtgcatccagttgctcaagcacatcatcttctgtcagcgtcgccattggtcttccgatagatcaccatcaatgcagggagtctattatattacacgtttggtccgcgccgccgatcagtaatgtctgcgtccgcaccccattcgccgtctgttggataccgttcaccaactcgccgcccgtcacgcccgtagcgctaaagaggatatcgttccccctcgccgataaccactcgcccacgaaaagcaacgtcgtttaatgcctggcgcatcgcggtgaccgcaaggccatcaattttatttttgtcgccacagccggtttgcggccaggcagccaacgctgcctgttccgtaacgcgaaataatggccacgccagggacatcattgcgtggcctccccaatatcaacgccaaattgtgccagcagatatttctcggcctgttcattccagataccgtgcgttttctcaaccagccgcgccagctctttaaacagcggatcggttttgcctttttcggcaaaatcggcaatggcggtcagcggcatggtcacgccgttataaatgagttttttaccgccagggatatccggcagattgagcacggtttctggcaccgcatccaggccaccgatatgggtcaccataaacgacggctgtaactgccccgtggcgctaagggcaatcgcctctttcatgtcgtccgtggaaccgccggacgtgccgacaatgtgtgtactgttgtaatggacgttgtagaaattaaacggcactttgaagtttttatccgtcggaccggcaaagaagttcaggcagccatcttcagccagtaattcatcagccatctcgacgactgaaggcaccgctgcatagacaaatacgtcatcaaatccggcatcatccgtcagcgcccgcagcgtctggaccggatcgctcatccctttggtattcatatacaccagctcaatgcctttactggccgccagttccaccggcagcagcttttgtacctgcgtcaggcgtttgtcgtcgatatcgactaccaccacccgcgccggttgtatgccgccgttaatagcgtaatcgatagcgccaattcccatcgggcctgcacacgccagtagcgcaatattgccgccaggtttgacgcccatgcgatgctcataaacatattgcgtggtgtgataattggcatgataagcgccaataatgcagcacataggctctgccagcgacgccgcagcaaaataagagccgtgatagggtaatacgcagcccaaattaatggcgatttcgggaataatcatataggtggcgttaccgccaaaatattcgtagctgtagcccgctgaatacccgcctggtaaccccatcgccggttgcaatacaaaacgctggccttttttatatttgccagtgagatttttacccacttcgacaataaccccagcacattcatgcccggtaatgaccggatgattttctaaatcgtcggggacgcgtttatgttcactaccgagtaacgccgctttccaggtggataaacaaacgctgtcagaaattacattcactaacagttcattatcggtaatttctggcagctcaaattcgcgcagacggacatcccgcttgccataaatagcagcaactttggttttcatttttacctctgtaatcagtgtttatgttcagcggttaattgattaaataaagtgtcgagttttggatcgccaatatagttattaatcagtatcagcggtttatccgtcacacgtttcacgcgcccttccagactggcatgagtaacaacgatatccgcatccgcaggcacgttttctatcgcgtaatgttttacttcaattgccagccccgctttttccagacgtttacagaaggtggttgcgcccatcgcgctggagcccatccccgcatcgcaaacaaaggcgatacgcttaacccggcttaacgagaatgccccctcttgtttcatcgccttaaccgcattggctgactgagcaaactcatcttcgctcttcgtttccaccgttttttccatcttcagtatcagcgaagtgatagcaaaggacaccagggtacctaccgtaacaccggcaattgtcgccaggaacgagcctttcggcgtcagtgccaggtaagcaaagatagaccccggacttgggccagccaccagaccaccgtccagtaagttaaacatccaggtgccagacataccgcccgcaatcatggcaataatggtcagcggcttcatcagcacatacgggaaatacagttcgtggatcccaccgaggaagtgaataatcatcgccccgggcgcagaacgtttactcatccctttaccaaacaaggtaaacgccagcagcagccccagaccaggacctggattggatgccaccataaagaagatggatttaccgttaaccgaagcctgttgcattcccagcggataatagacgccctgatcgatcgcattattaaggaaaagcactttcgccggttcattgatgactgacagcaaaggtagataacccgcatgtaccagcgcctcaatacactctttgacgaaagtattagcaattaacaccgccgggccgataacttcaaaacccagcagacaaaggagcatccccgcgatacctaatgagaagttattgataaccatctcaaaaccagcaggtatgcgtttttccagcgacttgtcgatatatttaatcaccagaccaccgagcggccccataatcattgagccaaggaacatcgggatttcagcgccgacgatcacaccaatcgtaccaattccgcccatgaccgcgccgcgtttaccgccgaccagatgaccaccggtagaaccaatcatcacgggcaataaataggtaatcatcggaccaacaattttggcgaaatgttcattcggcagccagccggtgggaataaataatgccgttataaatccccaggcaataaaagcaccgatattggggatgaccattgcagtcaaaaagcccccaaaagcctggacctttgcacgagcagacttgttttccataatattatcctgtagaggagagagtaattatccgcggctgataatgcccgctaattgtttttctgatgatgctgttaagagttgttcgagtatttcttcttcgcacagtaattcacttaacgcctgaatagcgccaatgtgcgaatcggcatcggcagcagaaagcccgatgagtaatttaattggttcgtcattccccggaaaataaacaccttgtttaagtaatgtcaaagacatcccggttttaagcgccccacattccggtcgtgcatgaggcattgccacgcctggtgcgagaatataataagggccattgttaatggtggaacctttaattgcctgaatgtaattctcgctgatatagtttttatccagcaatgataccatcgagaaatcgatagcttcctgccaatcttttgctgaatgtataactgagattgatgactctggaaaataatcaataagccgcataaattatccttattttatttttagggtacagtccggcggtaaaaataaaatacgcgtacaaattaacgaaagcaattggacacatgaaaggagaaactccacgagcaaaaataacaaaatattaaataacaacaacatgaaataagcttttaaaaagtcaattataaatctgttaagtaaactacaaaatcaacaaattattcatcactatatttgtgatacacatctctattttcttattgaatgttcgaaaacatacttattacgtttattattttttcgctcatcccctttataaattctgaattatcggctgttgtctgttttctcatcaccccatgtgacatattcctatactttactcaaggaagattcatatgaaagcacctgtttcattaacctcatttcgcccacaaaaatctcttgctatcgccattggcgtgcttgccgtggttgtgctgccatttctctcgtattacaccgttaatgaaggtgaacgcggcattttgctgcgctacggaaaaatcgtaaaagttgccgagccggggctgggttttaagatcccttttatggaaagcgtagagaaaatttccacgcgtaatcaggctgtggtctatcagggattacaggcctacagccgcgaccagcaaccggcacaaatgacagtatcagtcagcttccacattaaaccttcagaagcaggcgcggtttataccacctacaacaccattgaagcattaaaagatcgtctgattgtccgtcagttgccaactcaactggagaacgttttcggacaatataccgccatcagcgccgtacaggatcgcacaaaactggttcaggatctgcaaaatgccatgcgcaaagccgttgttgggccagtggtaattgacggggtccagattgaaaatattgatttttctgacgcttatgaaaagtcgattgaagaccgaatgaaagcagaagtcgccattgccacgcgtaagcaaaatctggaaacggagaaaatccaggcgcaaatagcggtaactcaggcccaggcggaagcagacagtaaactagcggcagccaaagcagaagcggaaactattcgcgtaagaggcgcggcagaggctgaaactattcgtttaaaaagtgcggctgaagcagaagctatccgcctgcgcggtgaagctctgcgggagaatcccggacttgttgccctcaccactgctgagcgttgggacggtaaactgcccgataccatgatccccggcagcacagttccgtttatctctactaagtaaaaaaagggccgctttcgcggcccttgagactgataccaaagacaaaactgcctgatgcgctacgcttatcaggcctacatacttcctgcaatatgttgaatttgcaaaatcttgtaggacggataaggcgttcacgccgcatccggcataaacaacgcgcactttgccaacaatctgaagggccgcatttgcggcccttctcacaaaacatcttaccgattacagcagcgcttttgctttcgcaacaacgttgtcaacggtgaagccgaactcttcaaacagctgctctgccggagcagattcaccgaaggtggtcatgccgacgatagcaccgttcaggccaacatacttgtaccagtagtcagcaatgccagcttccaccgcaacacgagcggtaaccgctttcggcagtacggattcacggtaagccgcgtcctgcttgtcgaatgcgtcggtagacggcatggaaaccacgcgcgctttcacgccttcggcagtcagtttttcgtaggcggcaacagccagttcaacttcagaaccggtcgcgatgaagatcagttccggctgaccagcacagtctttcagcacataaccaccgcgcgcgatgtttgccagctgctcttcagtacgttcctgctgcgccaggttctgacgggagaggataagcgcagtcgggccgtcctgacgctcaacgccgtatttccacgctactgcggattcaacctggtcacacggacgccatgtagacatgttcggggtcacgcgcagagaagcgatctgttctaccggctggtgagtcgggccatcttcgcccagaccgatggagtcgtgggtgtaaaccatcacctgacgctgtttcatcagcgcagccatacgtacggcattacgtgcgtattccacgaacatcaggaaggttgaggtatacggcaggaaaccaccgtgcagggagataccgttagcaatcgcggtcataccgaactcgcgaacaccgtagtggatgtagttacctgcagcatcttcgttgattgctttagaaccagaccacagggtcaggttagacggagcaaggtcagcggagccgccgaggaattccggcaacagcggaccgaacgcttcgatagcattctgagacgctttacggctggcgattttcgccggattagcctgaagtttagcaatgaactctttcgctttcgcgtcgaagtcagacggcatttcgcctttcatacggcgggtaaattcagcggcttcctgcggataagctttcgcgtaagcagcgaatttctcgttccatgcggactctttcgcctggcctgcttctttcgcatcccactgagcatagatttcagacgggatttcgaacggcgcgtatttccagcccagctgttcgcgggtcagggcaatttcagcgtcgcccagcggcgcaccgtgggagtcgtgggtaccggctttgttcggggaaccgaaaccgatgatggttttgcacatcagcagggacggtttgtcagtcactgcgcgcgcttcttctactgcgcgtttgatggatgccgcgtcatgaccgtcgatatcgcgaataacgtgccagccgtaagcttcgaaacgcattgcggtgtcgtcggtaaaccagccttcaacgtgaccatcgatagaaataccgttgtcatcgtagaacgcaatcagtttacccagcttcagcgtacccgccagagagcaaacttcgtgggagatgccttccatcatgcagccgtcgcccatgaaggcgtaggtgtagtggtcgacgatgtcgtggcccggacggttaaactgcgccgccagcgttttttctgcaatcgccataccgactgcgttggcaataccctgacccagcggaccggtggtggtttctacacctgcggtgtaacccacttccgggtgacccggagttttagagtgcagctgacggaagtttttcagttcttccatcggcagatcgtaaccggtgaggtgcagcaggctgtagatcagcatggagccgtggccgttggacagcacgaagcggtcacggtcagcccaggacggattctgcgggttgtgtttcaggaaatcacgccacaggacttcggcaatgtcagccatacccataggggcacccgggtgaccggatttggctttctgtactgcgtccatgctcagcgcacgaatagcattggcaagctctttacgtgaggacattttgactccagatcggatgatgaagggcacgcccttaacgacttgacgacagcgcgttttgggctacgccggaaaatttgccaacaatttaccgcaagccgcgcgtcatgtacatggaacatccttttgccgcttcagaaatctctggatcatgctcgcatgttgcgcaatccactcgcccgtccgctgcgcttttccttatactgagactgagcgtcgattcacctgcaaacggcgcatttttagaataatcctgaccttgtgcggaagagaaaacatgaaaattcgcgccttattggtagcaatgagcgtggctacggtgctgaccggttgccagaatatggactccagtggactgctctcatcaggagcggaagcttttcaggcttacagtttgagtgatgcgcaggtgaaaaaactgagcgatcaggcatgccaggagatggacagcaaagcgacgattgcgccagccaatagcgaatacgctaaacgtctgacaactattgccaatgcgctaggcaacaatatcaacggtcagccggtgaattacaaagtgtatatggcgaaggatgtgaacgcctttgcaatggctaacggctgtatccgcgtctatagcgggctgatggatatgatgacggataacgaagtcgaagcggtgctcggtcacgaaatggggcacgtggcattaggccatgtgaagaaaggaatgcaggtagcacttggtacaaacgcaattcgcgttgcggcggcctctgcaggcggaattgtcggcagtttgtcacaatcacaactgggagacctgggcgaaaagctagtcaattcgcaatttacccaacgtcaggaatcagaggccgatgattactcctacgacttgctgcgccaacgcggtatcagcccggcaggtcttgccaccagctttgaaaaactggcgaaactggaagaaggccgccaaagctcaatgtttgacgaccatcctgcatccgccgaacgcgcccagcatattcacgatcgtatgagcgcggatggagttaagtaaagccaggtagtgccgaacgtaggtcggataaggcgttcacgccgcatccgacattaatgacacatcacccgtgcgcctcttatctggcgcttactcgccctttttcgccgcctgaatatacagcatctccagcgccagcgtcgccgcagccagagcggtgatttccgactgatcgtatgccggagccacttccactacgtccatcccaacgatgttgagatctttcaagccgcgtaccagtttaatggcgcgatcggaggtcaggccgccaattaccggcgtaccggtgcctggtgcaaaagcaggatccaggcagtcgatatcaaaggtcaggtaaaccggcatatcacccacaatctgtttcacctgggcgataatgtcatccacgctgcgatcgttcacctggcaggcgtccagcacggtaaagccgttgtctttatcaaactcggtacgaataccaatctgcacggaatgattcgggtcgatcagaccttctttcggcgcggtatagaacatggtgccgtggtcaaattcacaaccgttagcgtaggtatcggtgtgggcatcaaagtgtaccaacgccattttgccgaaatgcttcgcatgagcgcgcagcagcggcagcgtaacaaagtggtcaccaccgaaggagagcatacgcttaccggcagccagcagcttctcggcgtgcgcctgcagcttctcgctcatctcacgggcatcgccgaaggcatataccagatcaccgcagtccacgacgttcaggcgctcacgcatgtcgaaattccacgggaagcggttgtgttcccaggccagattcgtcgaaacctgacggatcgctgccggaccgtggcgaccacccgcacgaccagaagtggccatatcgaacggcacgccagtaatcacccagtcagcatcgctgtcatatggctggaagttcatcggcaggcgtaaaaaaccaaaggcgttggaaaccagtgagttatcgtattgatgacctaaggtgctcatggatggactcctattacaaagtcgatataaaaaaacccttccgcgtcgttaggcccgacgaggaagggttggatttgtgaaacacaagtttgtgctaattatcgccttaaatgggcgaggcatcaagcgaggttgctatttccgacacggtggcggcgcatagccattgttatctgccggaaaggcttgtccagagcacggcggcagcgcgtttttcgccgggccttgtaattcaaaggcggcaaagccgattacaccggtattacgcacatcgccttgcgccgaattggctgcgtaggaatcagcaacgttggcgaactgaaaagccgcttcggtatgtttatctttgcggaatcctttaatcgctaacgaatctccggcattcacaatataaccgttgttattcagcgaaccttgcttgccgttcagcacatccaggccatcaaccgtagcaacgatctcgtagttggtgttacgactgtaattacggacatataattgataattcattccgactctggcatggacaatatagcgtggttcattattggatgaatcataaacccgcgtaataggtagagaattaaaattaccatcgcgaatagcatattccagttcgttaatacgaatgctataaacgcggtcgtagccggaaggaacattagtcgaataactaataacgatcatctctgccggatcgcgccaggctcgttcagcagatacgccctgaaccgttgagtgcacatccccaccccaggcggtgccgacattacccgatgcactgctattatactgcgcattactggaacaaccggccagcagcacgattaatgccaccaacgcgctacgtactttccattttttcataaccgttccctctgcatttaattaatgcagcgattgtagggagattatttaataagaaaagcagctaaattatttttaagaatatataaaaagaaagcggggcgatttacttaaataaatcgccccgccagcggaataatcttaattattcatcttcaagataggtataaccgtacaaacctgcctcgaactcttcaaggaactgttgttgcagttcagcatcaagatcggttttcttcacctgatcgcggaactgggttaacagcgttttcggatcgagctgcacatattgcagcatgtccgccacggtatcgccttcgtcagacagttctacctctacgctaccatcagggaagacgaacacgtcaaccgcttcggtatcaccgaacaggttgtgcatgttgccgaggatctcctgatatgcgccgaccataaagaaaccgagcatcggcggattctccggatcgtactccggcataggcattgtcgtggcaataccgtcaccatcaatatagtggtcgatagcaccgtctgagtcacaggtaatatccagcagcacagcgcggcgttccggcacttgatccagcccttccagcggcagaaccgggaacaactggtcgatcccccacgcatccggcatcgactggaacagcgagaagttgacgtacattttgtccgccatacgttcctgcagctcgtcgataatcggacgatgagcacggttttgcggatccagctgcttttgcacttcatggcacatgctcaaataaagctgctcagcccatgcgcgttcttgcaggctaaaggtgccggaagagtagccgatatgaatgtcgtgcagatccatctggctgtcgtgtaaccattcacgcagagaacggcgagttcccggttcgtgcatttcctgccaggtttcccacatgctttgcagggcgcgcggtgcgtcttctgcaggcgcggtcggcaccgtgtattcgttacgttccacgccgatgatattcgacaccagcacggtgtgatgcgcagtcaccgcacgacccgattcggtgattaccgtcggatgtggcagaccattttcttcacacgcatcaccaatcgcccagatgatgttgttggcgtattcattgaggccgtagtttacggagcagtcagactgcgaacgggtgccttcatagtccacgcccagaccgccgccgacgtcgaagcactgaatattgacgcctagcttgtgcagttccacatagaaacgcgcggattcacgaacgcctgtcgcgatatcgcgaatattcgccatctgcgaaccgaggtggaagtgcagcagttgcaggctgtcgagacgcccggcttcacgcagcgtttcaaccagttgcagtacttgagtcgccgccaggccaaacttcgatttttccccgccggaggactgccatttacccgagccctgcgacgccagacgtgcacgcacgcccagacgaggaacgacattcagacgttctgcttcatccagcacaatggcaatttctgacatcttctcaatgaccagatagaccttgtggcccatcttctcgccaattaatgccaggcggatatattcgcggtccttataaccgttgcagacgatgacgctacgggtcatgccagcatgtgccagcaccgccatcaactcggctttggaaccggcttccaggcccagcggttcgcccgaatgaatcagggactcaatcacccggcggtgctggttaactttgatcggataaacgaggaagtaatcgccgttatagccgtaggattcccgcgctcgtttgaacgcggcgttaatggaacgcaaacggtgctgcaggatctgtgggaaacagaacagtgcaggcagacgctgaccctgtgcttcgcgagttttcactaactgcgcgagatcgacgcgagcttccgggacgtccgggtccgggcacacgctgatgtggcccagctcgttaacgtcatagtagttattgccccaccaggcaatattgtaagtacgcagcatcttgctggcttcctgggagctcattgcaacctcctgcatggagcgtagtacaccgtgttcgcccgctgacgaaggcaaacccatagacatgtcgtcagacatagcgaacctcaaattattttattaagtgtaaaacagttaacgactatcgcagcctggaactgcgataacaacccataagcacatggattttccagcagtgaatgctgacgctccaactgcgcaaccggtttctttttcataacattattaagcacataaccgaacgtaagtgtgacagttcggcgaaaccacgagaaaactcttgtttttacaagagcgcccttgttcagtcctcagtagctgtaaccagctcttgaatcctgagaagcgccgagatgggtataacatcggcaggtatgcaaagcagagatgcagagtgcggggaacgaatcttcaccagaacggtgagacaggttaagcagcagacaacggttcattatttcgtatcacctccacggccgcctgttaagacgaacccacaagccaaaactctgttttcaacccggctggaagtggcaacacgaaagaaacgtcgtgtgctttttatttaagccgcgcgccgcgttttataccccacaatggcagaaaattgcaaaagataaatacgcagaatgccagcattgtcaggaaaaatttccagccacgtttttaacagaatgagacacgattcaaaaaaaagtggaaattgggtgaagaactgacctaaaatagccatccagatgttaatccatccataccgattaacactcagactgccagtgtttttaacctgcagagtcgtggtaggatccgctaccacagaaaatccacacaacagtttgagctaaccaaattctctttaggtgatattaaatatggcaaaacacctttttacgtccgagtccgtctctgaagggcatcctgacaaaattgctgaccaaatctctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaataccgttcgcgaaattggctatgtgcattccgacatgggctttgacgctaactcctgtgcggttctgagcgccatcggtaaacagtctcctgacatcaaccagggcgttgaccgtgccgatccgctggaacagggcgcgggcgaccagggtctgatgtttggctacgcaactaatgaaaccgacgtgctgatgccagcacctatcacttatgcacaccgtctggtacagcgtcaggctgaagtgcgtaaaaacggcactctgccgtggctgcgcccggacgcgaaaagccaggtgactttccagtatgacgacggcaaaatcgttggcattgatgctgtcgtgctttccactcagcactctgaagagatcgaccagaaatcgctgcaagaagcggtaatggaagagatcatcaagccgattctgcccgctgaatggctgacttctgccaccaaattcttcatcaacccgaccggtcgtttcgttatcggtggcccgatgggtgactgcggtctgactggtcgtaaaatcatcgttgatacctacggcggcatggcgcgtcatggtggcggtgcattctctggtaaagatccatcaaaagtggaccgttccgcagcctacgcagcacgttatgtcgcgaaaaacattgttgctgctggcctggccgatcgttgtgaaattcaggtttcctacgcaatcggcgtggctgaaccgacttccatcatggtagaaactttcggtactgagaaagtgccttctgaacaactgactctgctggtacgtgaattcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgtgatgctgccggtctgaagtaatctttcttcacctgctttcaaaggccagcctcgcgctggtctttttcttttacctcaccgcggtggacaggcattcacgccgcatccggcaaaaaaaccgcccgcacaataacatcattcttcctcaacacgttttaccgcaaattatcatcactactgaaaccgattacaccaaccacgccagccaaatatttgtaatattttcatattattattcagccttcacagttgttacattttttttcagtaaagtcttaattgcagataacaacctttaatctatgatgatataactcaattattttcatgcacttaaatcataactaagataaatgttagtgtaagcgattacactgatgtgatttgcttcacatctttttacgtcgtactcacctatcttaattcacaataaaaaataaccatattggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaatcttgtttgttgccggttcactgttctctgctgctgcgccaaacgttgaagtactgattctttcccgcgttttgctggggctggcagtgggtgtggcctcttataccgcaccgctgtacctctctgaaattgcgccggaaaaaattcgcggcagtatgatctcgatgtatcagttgatgatcactatcgggatcctcggcgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaatagcaacttccgccgcgcggtgttccttggcgtactattgcaggtaatgcagcaattcaccgggatgaacgtcatcatgtattacgcgccgaaaatcttcgaactggcgggttataccaacaccaccgagcaaatgtgggggacagtgattgtcggcctgaccaacgtacttgccacctttatcgcaatcggccttgttgaccgctggggacgtaaaccaacgctaacgctgggcttcctggtgatggctgctggtatgggcgtactcggtacaatgatgcatatcggtatccactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgctgctctgaacgtactgtttatcctgctgacattgtggctggtaccggaaaccaaacacgtttcgctggaacatattgaacgtaatctgatgaaaggtcgtaaactgcgcgaaatcggcgctcacgattaatctcctcaggcttcctcccatcatggaggaagccacctcttgcagtcatcttttcttcgctctatcctctgccgctatgaaaacatcccgtctccctatcgccatccaacaggccgttatgcgtcgcctgcgggaaaaactcgcccaggccaacctgaagctagggcgtaactacccggagccaaaactctcttacacccagcgcggaacctctgccggaacagcctggctggaaagctatgaaattcgtctcaatcccgttttgctgttggaaaacagtgaagcctttattgaagaagtggtgccgcacgaactggcacatttgctggtatggaaacatttcggccgcatagcgccacatggcaaagagtggaagtggatgatggaaagcgtgctgggcgttcccgcccgccgtacgcatcagttcgaactgcaatccgtgcgccgcaacaccttcccctaccgctgcaagtgccaggagcatcagcttaccgtacgccgtcataatcgcgtagttcgtggcgaagccgtctatcgctgtgttcactgcggcgaacagctggttgcgaaataaccacctgaactatcaggaactttcctgatctggctgattgcataccaaaacaactttcgctacgttgctggctcgttttaacacggagtaagtgatgtaccattatttgtctattgctgcggtggtactgagcgcagcattttccggcccggcattggccgaaggtatcaatagtttttctcaagcgaaagccgcggcggtaaaagtccacgctgacgcgcccggtacgttttattgcggatgtaaaattaactggcagggcaaaaaaggcgttgttgatctgcaatcgtgcggctatcaggtgcgaaaaaatgaaaaccgtgccagccgcgtagagtgggaacacgtcgttcctgcctggcaattcggtcaccagcgccagtgctggcaggacggtggacgtaaaaattgcgccaaagatccggtctatcgcaagatggaaagcgatatgcataacctgcagccgtcagtcggtgaggtgaatggcgatcgcggcaactttatgtacagccagtggaatggcggtgaaggccagtacggtcaatgcgccatgaaggtcgatttcaaagaaaaagttgccgagccaccagcgcgtgcacgcggtgccattgcgcgcacctacttctatatgcgtgaccaatacaacctgacactctctcgtcagcaaacgcagctgttcaacgcatgggacaagatgtatccagttaccgactgggagtgcgagcgtgatgaacgcatcgcgaaggtgcagggcaatcataacccgtatgtgcaacgcgcttgccaggcgcgaaagagctaacctacactagcgggattctttttgttaacccctaccccacgcgtacaaccgcgtggggagacgacgcggatttttaactatgcgtatcccccgcatttatcatcctgaaccactgaccagccattctcacatcgcgctttgcgaagatgccgccaaccatatcgggcgcgtactgcgtatggggccgggacaggcgctgcaattgtttgacggcagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagctccagcagtggcagaagattgcaattgctgcctgtgagcagtgtggccgtaaccgggtgccggaaatccgtccagcgatggatctggaagcctggtgtgcagagcaggatgaaggactgaaactgaatcttcacccgcgcgccagtaacagcatcaatacgttgccgttaccggtcgaacgcgtccgcctgctgattggcccggaaggcggtttatcggcagatgaaattgccatgactgcccgctatcaatttactgatatcctgttgggacctcgcgttttgcgtactgagacaactgcgctcaccgccattaccgcgctacaagtgcgttttggcgatttgggctaacggagaagaataatgatcaagctcggcatcgtgatggaccccatcgcaaacatcaacatcaagaaagattccagtttcgctatgttgctggaagcacagcgtcgtggttacgaacttcactatatggagatggccgatctctatttgatcaatggtgaggctcgcgctcgtacccgtactttgagcgtcgaacagaactacgataaatggtacgagttcacgggtgagcaggatctgccgctggccgatctcgatgtgatcctgatgcgtaaagacccgccgtttgataccgagtttatctacgcgacctatattctggaacgtgccgaagataaagggacgctgatcgttaacaagccgcagagcctgcgcgattgtaacgaaaaactgttcactgcctggttctctgacttaacaccagaaacgctggtcacacgcaataaagcgcagctaaaagctttctgggaaaaacacagcgacatcattcttaagccgctggacggtatgggcggcgcgtcgattttccgcgtgaaagaaggtgatccaaacctcggcgtgattgccgaaaccctgactgagcatggcactcgctactgcatggcgcaaaattacctgccagccattaaagatggcgacaaacgcgtgctggtagtggatggcgagccggtgccgtattgcctggcgcgtattccgcaggggggcgaaacccgtggcaatctggctgccggtggtcgcggtgaacctcgtccgctgacggaaagtgactggaaaatcgcccgtcagattgggccgacgctgaaagaaaaagggctgatttttgttggtctggatatcatcggcgaccgtctgactgaaattaacgtcaccagcccaacctgtattcgtgagattgaagcagagtttccggtgtcgattaccggaatgttaatggatgccatcgaagcacgtttacagcagcagtaacccaccttagcgagaaggatctcgttgagactctgagtgacagcgcccttctttccacgcatactgggcgctgttgcttttttgaaccaggaaacagaacctctgacaatgaatttacagcatcactttcttattgccatgcctgctctccaggatccgattttccgtcgttccgtggtctacatttgcgaacataataccaatggtgcaatggggatcatcgtcaacaagccgctggaaaatctcaaaattgaagggattctggaaaagctgaagatcacgccggagccgcgtgatgaatcaatccgtctggataaaccggttatgctcggcggtccgctggctgaagatcgcgggtttattttgcatactccgccctccaattttgcttccagcattcgcatttcagacaacacagtgatgaccacttcccgcgatgtgctggaaacgctcggcaccgataaacaaccgtctgacgtattggtggctctgggttatgcctcctgggagaaaggtcaactggaacaagaaattctcgataacgcgtggctaacggccccggcagatctgaatattctgttcaaaacgccgattgcggaccgctggcgcgaggcggcaaaactgattggtgtggatattctcaccatgcctggtgtggcaggacacgcctgatgagtggaaccttactcgccttcgacttcggcaccaaaagcattggcgtagcggtcggccaacgcattaccggcaccgctcgccctttgcctgcaattaaagcgcaggacggtacgccggactggaacattatcgagcgtttactgaaagagtggcagccggacgaaattatcgtcggtttgccgctgaatatggacggcaccgaacagccgttaaccgccagagcgcgtaaatttgccaaccgtattcatggtcgtttcggtgttgaagtaaagctccatgacgagcgtcttagcaccgtggaggcacgttccggtctgtttgaacagggcggctatcgggcgctcaacaaaggcaaagtcgactctgcctctgcggttattattctcgaaagctatttcgagcagggatattaaggcgatttactagcgcacagatttctgacaatgtgctcgttgtttcatgttggatgcggcgtaaacgccttatccaacctacagtgagtgcgaattcaaagttacgcttcccttgtaggcccgataagcttgcgcatcgggcatatttacaattcgtatcagacacagcaacgtcacaagcgcccttctttcacccgctgctgataactctgctgaaacgttatcatccccacctgctgcccggtttgaataacatgcggtaactggtgggttttcccttcacgaatcaaattccccaccgcgggtgtgttaatcagtaattcaaacagcgccacgcgtccttcctgtttatccacttccagcttttgtgacaacaccgcccgtaaactacctgccagttgattacgcacgggatctttttcctgcgccggaaacgaatccaccagtcgctcaactgcctgcgctgcgccgcgcgtgtgtaatgtcgccagcaccagatgcccggtttctgccgccgtcagcgccagacggattgtctcgctatcacgcagctctccgagcaaaatcacatcaggatcttcccgcaatgcagcccgcaatcccgatgcgaacgtcatacagtgcaaaccaatctcccgctgttggatcaaacatcgctgactggtatagagatattccacaggatcttccagcgtcagaatatgcgcatcggcatgttgattgagatagccaaccatcgccgccagcgtggtagatttgccgctccccgtcgcccccgtcaccagaatcaggccattctcgctcttgagtaattccggcaataccggtggtgcgccaagctgttcgagctgcgggcagtgcgaaggtaacagccgtaacgccagagaaataccttgccgttgtgcgaacgcactgccgcgcaatcgctggttttccgccagcgacacagcaaaatccagctgaccattctccagcaatattgcccgctgatcgtcatccagccactcccacagtagctcttcgacgtccggcgcgtcaaacggcgcagcttccattctcccgcgaatacgccatcgtgcgggccaggcgctgcacaggtgtagatccgagacgttatgctttacactaagggccacaatttcttccatattcatactaagatcctcggaaaatgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgagcgtaacaggattagaatggcattttattggcccgttgcagtctaataaaagccgcctggtggcagagcatttcgactggtgtcataccatcgaccgtttgcgcatcgctacccgtctgaacgaccagcgcccggcagaacttccccctcttaacgtactgattcaaattaacattagtgatgaaaacagtaagtccgggattcaactggctgaactggacgagctggcagctgcggtcgctgaactaccgcgtttacgtctgcgcgggctgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataaggaattaaaggaacgccatgaatacgttgactttcctgctttcaacggtcattgagctgtataccatggtgctgttattacgcatctggatgcagtgggctcattgtgatttttacaaccccttctcacagtttgtagtgaaggtaacgcagccgattatcgggccactgcgccgcgttattccggcaatgggccccattgatagcgcctcgctgctggttgcctatattctcagtttcattaaagccatcgtgctgtttaaagtggtgaccttcctgccaattatttggattgccggtttattgattctgctgaaaaccatcggcctgctgattttctgggtcctgctggtgatggcgattatgagctgggtaagccagggtcgtagcccgattgaatacgtgctgattcagctggccgatccgctgctgcgcccgattcgccgcttgctaccggcaatgggtgggattgatttctcgccgatgatcctcgttctgctgctgtatgtcatcaatatgggtgtcgcagaagtcttgcaggcgaccggaaatatgctgctgccggggctgtggatggcgttatgagtgccgtaacagttaatgatgacggtctggttttacggctctatattcagccaaaagccagccgtgattctattgtcggtttacatggcgacgaggtaaaagtcgccattaccgcgccgccggttgacggccaggccaacagccatctggtgaagtttctcggtaagcaattccgggttgccaaaagccaggtggtgattgaaaaaggcgaacttggccgccacaaacaaattaaaatcattaatccgcaacaaatcccgccagaaatcgcggcgttaattaattaggtatcctatgcaaaaagttgtcctcgcaaccggcaatgccggtaaagtgcgtgagctggcgtcgctgcttagcgacttcggtcttgatatcgttgcccaaacagacctcggcgtagattccgctgaagaaaccggcctgacctttatcgaaaacgcgattctgaaagcgcgccatgcggcaaaagtgaccggtttaccggcaattgccgacgactccggtctggcggtagatgcgctgggtggcgcgccgggtatttactccgcgcgttattccggtgaagacgcgaccgatcaaaagaatctgcaaaaactgctggaaacaatgaaagacgtaccggacgaccaacgtcaggcgcgtttccactgcgtgctggtatatctgcgtcacgcggaagatcccactccgctggtatgccacggtagctggccaggcgtgattactcgtgaaccagcgggcactggtggctttggttatgatccaatcttcttcgtaccttccgaagggaaaaccgctgccgaactgacccgcgaagaaaagagcgccatttcccaccgtggtcaggcgttgaaactgctgctggacgctttacgtaatggttaaattaccgccgctgagtctctacattcacatcccgtggtgcgtgcagaaatgcccgtactgcgatttcaactctcacgcgttgaaaggagaagtgccgcacgacgattatgttcagcatctgcttaacgatctggacaacgatgtggcttacgctcagggccgtgaagtaaagacaatctttattggcggtggtacgccgagcctgctttccggcccggcgatgcaaacgctgctggacggcgtacgtgcgcgtttgccgctggcagcggatgcagaaattacgatggaagcgaatcctggtacggttgaagccgatcgctttgttgattatcagcgtgctggtgtgaaccgcatctccattggcgtacagagttttagcgaagaaaagctgaaacgacttgggcgcattcatggcccgcaagaagcgaaacgagcggcaaatctggcgagcggtttagggttacgtagctttaacctcgatttgatgcatgggctgccggatcaatcactggaagaggcgctaggcgatctgcgccaggctattgaactgaatccgccgcatctttcctggtatcaactgaccatcgaacctaatacgctgtttggctctcgccctcctgtactgccggacgatgacgcgctgtgggacattttcgaacaggggcatcagttattaaccgcagcgggttatcagcaatatgaaacttccgcttacgccaaacccggttatcagtgccagcacaatctcaactactggcgctttggtgactacatcggtattggctgcggcgcgcatggcaaagtgaccttcccggatgggcgcattctgcgtaccaccaaaacgcgtcatccacgtggttttatgcaggggcggtatctggaaagccagcgtgatgtcgaagccgcagataaaccatttgagttctttatgaatcgcttccgtttgctggaacctgcgccgcgcgtggagtttagccagtatactggcctttcagaagaggttattcgccctcagttagacgaggctatcgctcagggttatctcacagaatgtgcggattactggcagataacggaacatgggaagttgtttttaaattcgctgctggagctttttctggctgagtaaatttgtattgccggatgcggcgtgtacgcaacatccggctacaactcttgcgtcatcgcaaaaattacttaatcaccccattgcgccgcaattgttcggtatcttttttccagcgttcattagcctggttgatatcgtcaattttcatcaaaatcgtgacttttttactgtttatttctgaaactttcatcgttaacggatattgccctttttcgagcgttatccagtcatcctgcaatttacggctaagtttttgtgattgcagaaaagtctgtcgccgttgttcgttgatatcaaaatctcgtttctgctgaattggcacttcataacactcttcactctgtttatgacatgccgcaatcgccggttgataaacctctttgtcatatttaaccgcgaacgcctcactatcgttctgtttattaaaatcatcacgctgttggtgaatttttttaaaggcgtcttcacgggtcatttgcttaccgtttgcatcttttccccaatatgcatccgctgctttctgcgccgccaccatttgcttatcaagcgcttttacatcctttttcagtgcaggaatcgagttattctggttattcaatgcagactcaagctgactaaagcgataattgaaatcttcgctattcacgatcagatatttattattggttttgatatcgtcaaccacccgcccacgatcgctggctgccgcctgaaaagagtaaaagttcaccgaccagccagacgcgggcgttcctttactggttaacatcgccgagaatttcaccggtttatctttcgtccaggtctgttcgagcagctcgtaatctgccaactgaccgacccaggtatagagatcgtcactggaagagacatcgccttccgctgaccaggtggcctgattacccttagcatcaagattttttaaggtgatgacatcaagcttgagaatgccgtgatactgctttttgaattgatcttttaagatattttcagttggcggttcaccatctgcccggacattaccagtcatcaacataagcagcgccgtaccaacaatccattgctttttcacccgaaaaccctcgcgcggaataatttattctggtgattatcattagggtaataaaaattggcaatggacgtgagtctgaagtgaataagccccggcacgataccggggcgaagtgattagtactgattgaagatctgctggatctgctgcggatctttagtttgcgtcagagccagttgcagcagaacgcgcgctttttgcgggttcaacgtgccagaggcgacgaagccgtatttcgcatcatccacttcggcatcctgagtggtagcgcccgtcggtacgcgggaagaacgcactactgcagtgccgtttttcgcagcggttgcaagggtgtcaaatacggttttatacaggttgccgttacccacgccagcgctaacgatgccatcatagcccgcatctaccagtgctttagccggaagatcggatgcgttagcgtagttataaacaatgccgactttcggcagttcattcagcttagagacatcgaacggcgtgtcgctggtgtgcttacgtgccggggtacgttggtaatcaatcttaccgttgtgaatgtaacccagaggaccgtagttaacagacttgaaggtcgctacgtcggtggtgttggttttggtgacatcacggccatcaagcacggtgtcgttcatcactaccagtacgccacgattagcggaggctttatcagctgcggtcactaccgcgttatacaggttgaatggaccgtctgcgctcatagacgtggacgggcgcattgcaccgaccatcaccaccggtttgtcgcatttcaccgtcaggtcgaggaagtaagcggtttcttccatcgtgtcggtaccgtgggtaatgacgaagccgtcagttttatcgcagtcggtgttaatttttttcgccagtgtcagccagacatcatcgttcatgtcctgggagccaatattcactacctgctcgcctttaacgttcgcaatgtccttcaattgcggcaccgcattaaccagattttctacgccaactttacccgctgtgtagttagatttggttgcggagtcaccaccaccggcaatggtcccgccggttgctaaaatggtgatattgggtaatgccaatgctgcaccactaaaacccataaccagtgcggcaagtgccgtctttttgaaaaactccatttcattcctccagttacgtgaacgctacgcattatcccttagctttgcatgggaaatttgacgttaaacaatttacaacgtgaatatattttggagatctacaaagttagaggcaggtaacaaaacgaagaattaaacggcataaaaaagtattatgccgtcttaaaatagaggattattttaaattcccgaccagggctttgcggctatcttccagagtcacaacgcggctacaaacatctttgccaaactgctggaaatctttttcctgctttttccactcggtttggattgaggattgcagaccgcccaggcttcccagcacgttctgtaatgggttaccgccgcttttcagcaccgctttcgcgcccatttcattaatgctgtcctgtaaaattccgcccattgcctgattcactaattgctggccttcggcacgaacctgatcaatggctttatagtgaaacgtcaggccatcgctgcgcgtttcgataatgcggttcatctgctctttcagctgcgcatcaagtttggtcagacggctgcgcattttgctgctttcgcccatctcctgaacgataattttatccagcgcaatacgggctttctcgacgcggcttttcgcgccttcatcaatccacggcagggtgctacgtagttcagcctgataatccttcgcctgctcgcgctgggcggcattcagggaatattgcttaccgttatacatcacgttgccgtctggcgtgatcaccagattgccgttttcgcccttcacctgcacggtttgcgggctgacaatcacatcgtcacgcggcgtgacgctgcactggtagtcggcgtgagcggtcattgccgtcactgaaagtgctgccgccagcagcattttgcgcatcatagtcttccctcaagaacaaatcaggccagcatttgctggccccagattgataacaaagtgcgcgttttccatgccggatgcggcgtaaacgccttatccagcctactcgatcgtgcatctttgtaggcctgataagcgtagcacatcaggcagttttgcatttgtcatcgcccgtatgctttcttagtcccaccaaacgtcgaaaagttcgctggtgcgtacctcttccagtttgcgttcttccagccacttacgcacaatcgcctgatgctcttcggtgcatttgccgatttcctgcatgcagatcaaaccttcccaggccagatatccgctgccgtcaaaggccagtttgttcggttcgataacctcgttaataaagtcatcaacggttttatcaatctgttcttccgatgtaccttccgggaatcgccatgccaccgaaaatcctaattcctggaattcgtcgatgtgcatttttttacgcagacgacggctacggttctttgccattatttcaccctctcgaacattaagtcccatactccgtgaccaagacgatgaccacgttgttcaaatttcgtcaccggacgtgatgccggacgcggtacgtaatcattgctctctgacaggtttttataaccgtcaatagaagacatcacttcaagcatatgttccgcataaggttcccagtcggtcgccatatggaatatgccccccagctgcagtttgctttttaccagctcggcaaacggcacctgaatgatacggcgtttattatggcgcgctttgtgccacgggtcagggaaaaagagctgcaccatgcgcaatgaattgtcaggaatcattttatgcagcacttcaaccgcatcgtgacacatcacgcgcaggttgcttaagccctcttcatgcgcagaagccaggcacgcaccaacgcccggtgaatgcacttcaatgccgaggaagtcctgctcggggcgatctttagccattgccaccaacgacgcgcccatgccaaaaccaatctcaagcgtcaccggcgcttcacggccaaaaagcgcagggaaatccagcatatcttcgctgaactcaacgcccatcaccggccagtagttttccagcgcatgttcctggcctttggtcagtcgcccctggcggcgcacaaaactacggatacggcgcagcgggcggccgttttcatcaaattccggtgagatgacgtcgtttttcataaagatttagtcgcttgtgaaagtgttctgaaaacgggcattatccaaagttagttgccggatgcaagcatgataaggccgtggctgcggaaagttccggtttacaccctgccgtcgctgtgctgcaatcttgcccccaacaacagtgaattcggtgaccatgcaagcgtcgcaattttcagcccaggttctggactggtacgataaatacgggcggaaaacgctgccctggcaaattgacaagacgccctacaaagtatggctctcagaagtgatgttgcaacaaactcaggttgcgaccgttatcccctattttgaacgctttatggcgcgcttcccaacggtgaccgatctcgccaatgcgccgctcgacgaagttctccacttgtggaccgggcttggctattacgcccgcgcgcgcaacctacataaagcggcacaacaagtggcggccttacacggcggtaaattcccggaaacctttgaggaagttgcagcactgccgggcgtcgggcgttccaccgcaggcgcgattctctcgctttctctgggtaagcactttccgattctcgacggtaacgtcaaacgcgtgctggcgcgctgctatgctgtaagcggctggcccgggaaaaaagaggtcgagaataaactatggagtttgagcgagcaggtgacgcccgcggttggcgtggaacggtttaaccaggcgatgatggatttgggcgcgatgatttgtacgcgctctaagccgaaatgctcgctctgtccgctacaaaacggatgtattgccgccgccaacaatagctggtcgctttatccgggcaaaaaaccgaaacagacgctgccagagcgcaccggctactttttgctgttacagcacgaagatgaagtattgctggcgcagcgtccgccgagcggattgtggggcggtttatactgtttcccgcagtttgccgatgaagaaagtttgcggcagtggctggcgcaacggcagattgctgccgataacctgacacagctgaccgcgtttcggcataccttcagccatttccacttagatattgtgcctatgtggcttcccgtgtcgtcattcaccggctgcatggatgaagacaatgcgctctggtataacttagcgcaaccgccgtcagttggcctggcggctcccgtggagcgtttgttacagcagttacgcactggcgcgccggtttagcgcgtgagtcgataaagaggatgatttatgagcagaacgattttttgtactttcctgcaacgtgaagcagaaggtcaggattttcagctgtaccccggcgaactgggaaaacgcatctataacgagatctccaaagaagcctgggcgcagtggcagcacaaacaaaccatgctgattaatgaaaagaaactcaacatgatgaatgccgagcaccgcaagctgctggagcaggagatggtcaacttcctgttcgagggtaaagaggtgcatatcgagggctatacgccggaagataaaaaataaaaacagtgccggagcacgcctccggcaacttgcataaaaacaaacacaacacgcacccggaatgatgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggcttcaaaaaggtggtgatcgccggtcctaaggactacgtgaaatacaccgatcaatatcagacccgcagccacatcaacttcgatgacggtacgattactatcgaaaccatcgccgggacagaacctgccgcgcatttgcgccgggcaataatcaaaacgttgctgatgggggacgatccgagttcggtcgatctctattccgacgttgatgatattacgatttcgaaagaacctttcctttacggtcaggtggtggacaacaccgggcagccgattcgctgggaaggtcgcgcgagcaacttcgcggattatctgctgaaaaaccgtctgaagagccgcagcaacgggctgcgtatcatctacagcgtcaccattaacatggtgccgaaccaccttgataaacgtgcgcacaaatatctcggcatggtccgccaggcgtcacgcaaatatggcgttgatgagtcgctgattctggcaattatgcagactgaatcttcctttaacccgtatgcggtcagccgttccgatgcgctgggattaatgcaggtggtacaacatactgccgggaaagatgtgttccgctcgcaggggaaatccggcacgccgagccgcagtttcttgtttgatcctgccagcaatattgataccggcaccgcgtatctggcgatgctgaacaacgtttatctcggcggaattgataacccaacatcgcggcgttatgccgtcatcaccgcctataacggcggcgcaggcagcgtgctgcgagtcttttcgaatgataagattcaggctgccaatattattaacaccatgacgccgggcgatgtttatcagacgctgacgacccgccatccctctgcggaatctcgccgttatctttataaagtgaataccgcgcaaaaatcttaccgccgccgataattccactaaccgcccctgacgatgctcaggggtaaaaatgttatccacatcacaatttcgttttgcaaattgggaatgtttgcaattatttgccacaggtaacaaaaaaccagtccgcgaagttgatagaatcgcatcatctcgcacggtcaaatgtgctttttcaaacactcatccgcatcacgatgtgaggaaattaacatgaatcttaagctgcagctgaaaatcctctcttttctgcagttctgtctgtggggaagttggctgacgaccctcggctcctatatgtttgttaccctgaagtttgacggtgcttctatcggcgcagtttatagctcactgggtatcgccgcggtctttatgcctgcgctgctggggattgtggccgacaaatggttaagtgcgaaatgggtctatgccatttgccacaccattggcgctatcacgctgttcatggcggcagaggtcactacgccggaggcgatgttccttgtgatattgattaactcgtttgcttatatgccaacgcttgggttaatcaacaccatctcttactatcgcctgcaaaatgctgggatggatatcgttactgacttcccgccaatccgtatctggggcaccatcggctttatcatggcaatgtgggtggtgagcctgtccggcttcgaattaagccacatgcagctgtatattggcgcagcgctttccgccattctggttctgtttaccctgactctgccgcatattccggttgctaaacagcaagcgaatcagagctggacaaccctgctgggcctcgatgcattcgcgctgtttaaaaacaagcgtatggcaatcttcttcatcttctcaatgctgctgggcgcggaactgcagattaccaacatgttcggtaataccttcctgcacagcttcgacaaagatccgatgtttgccagcagcttcatcgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgctctgtttgcttacggcgacccgactccgttcggtactgtactgctggtactgtcgatgatcgtttacggttgcgcattcgacttcttcaacatctctggttcggtgtttgtcgaaaaagaagttagtccggcaattcgcgccagcgcgcaggggatgttcctgatgatgaccaacggcttcggctgtatcctcggcggcatcgtgagcggtaaagtggttgagatgtacacccaaaacggcattaccgactggcagaccgtatggctgattttcgcaggttactccgtggttctggccttcgcgttcatggcgatgttcaaatataaacacgttcgtgtcccgacaggtacacagacggttagccactaattacgcaaagaaaaacgggtcgccagaaggtgacccgtttttttattcttacttcaacacataaccgtacaaccgtttcatgccattcgcatcggtttcgctatagacaccttgcaactccggcgaaaatcccggcaacaaattcacgccttcttccagcgcaaggaaataacgttgaaccgccccaccccagacttccccgggtaccacgcaaagcacgccaggtggataaggcaacgccccttctgccgcaattcgcccttcggcatcacgaatccgcaccaactccacttcaccgcgaatataagcgctatgcgcatcctggggattcatcaccactgacgggaaactctgctggcggaacatcgctttttgtaggtctttgacgtcgaaactgacatacagatcgtgcatctcctgacacaactgacgcagggtgtagtcgcgatagcgcaccggatatttgttataaacgctcggcaacacctcagccagcagcgagtcatcctcaatatgctgttcaaactgcgccagcatcgccaccagttgtgccagcttctcgtggctttccgccggagttaataagaacagaatggagttgagatcgcacttctccggcacaatgccgttctcacgcaggtagtgcgccagaatcgtcgccggaacgccaaagtcgctatattcgccggtttcggcatcgatacccggcgtggtgagtaacagcttgcacggatcaacaaaatactgatccgcggcatatccttcaaagccgtgccacttcgcccccggctcaaaactgaaaaaacggcggtcgctggctaacactgacgtcggataatcctgccacaatttgccatcaacaacaggcgggataaacgggcggaacagcttacagcgcgcaagaatagccttgcgcgactcaatacccaactcaacgcactcagcccacagccgacgcccactctccccttcatgaattttggcgttaacgtccagggcggcgaacagcggatagaacgggctggtagaagcatggagcataaaggcattattcaaacgcttatgcgggcaaaaacgcgcctgtccacggatatggttatcttttttatggatctgcgacgtctgtgagaatcccgcctgctgtttgtgcaccgactgggtcacaaagatccccggatcgttttcgttaagttctaacagcagcggcgagctatccgccatcatcgggataaactgttcgtaaccgacccacgcggaatcaaacagaatgtaatcacacagatgcccaacggtatcgatcacctgacgggcgttatagacagtgccgtcataggttcccagctgaataatcgccaggcgaaacgggcgcggcaggtcggctttttctggcgcaacgtcgcgaatttgctggcgcagatactcttcattaaaacagtgcgcatcaataccgccaatgaaaccaaacgggttacgtgaagcttccagatagaccggcgtcgcccccgcctgaatcaacgcgccgtgatgattcgacttatggttgttacggtcgaagagcaccagatcgccacgcgttaacagcgcattcgtcaccactttattcgctgccgatgtgccgttcagcacaaaataggttttatcggcatgaaagactttggctgcaaatttctgcgcatctttcgccgatccttcatgaataagcagatcgcccaattttacgtcagcgttacacatatcggcgcgaaagatgttctcgccaaagaaatcgtaaaaatggcgtccggcaggatgctttttaaagaacgcaccatgttgatgtccagggcaagcaaaggtgctattacccatctcaacgtactgcgtcagcgtgtcataaaacggtggcagcaaattctcttcatactgacaggctgcggattccagctccagccactgctgctcgttgccgttgattaccgccgtaacgcccgcaggtaattcaacagcatgttcggaatacaaaaacaccggtagatgaaaaccggtgcgcttaagcaacgcaagaatgccactgcgactatccgcagcggtaatgacgactgccgcgacgtccgtaaaatcagtatctcccaacgctaccacgcagcgatgagtagaaagtcgggataccagttcactactggcggcaatattcattgatttcataagcgcaaaacccgtttcggggaagtaagaataccggacaaggtggaaaaccctgccccatgagatatgggtcaaactggtcaccagctccgaccgccagacatcagtaaaagcagaaacgctctgattttactgttgtcctgcagtgagcgtgcgttgacttcaccgcatgagcagtagcataaaaagagaagagtttcgcgcgaaacggcgataagcgagagaatgtaaggaggtggcgtgcatcgggcaaactccgtacagagaggagaaaattcgcgcaatcatggcacctttcgctaaagcgtgcaagccaggactttgcgaacaaacaagccatcgacggcgccaaaagttcataataagaaaatcaaacaatacagctaacaggaactcttgtggtcatcggcccttttatcaacgcaagtgcagtcttactgggtggcgttttcggcgcactccttagccaacgcttaccggaacgtatccgcgtctccatgacatcaatttttggtctggcatcgctggggattggtattttactggtggtgaaatgcgccaaccttccggcgatggttttagcaaccttactcggagcattaatcggcgaaatttgtctgctggaaaaaggcgtcaatacagtggtcgccaaagcgcatagtctgtttcaccactcgcgtaagaagccagcgcatgaatcttttattcagaattttgtcgcgattattgtcctgttttgcgccagcggcaccggaatcttcggggcgatgaacgaagggatgaccggcgatccgagtattttaatcgccaagtcatttcttgatttctttacggcgatgatcttcgcctgctcgctgggtattgcggtgtcggtgattagcattccattactgatcatccagttaacactggcgtgggctgccgcgctgatattaccgctgaccacaccgtcgatgatggcagacttcagcgccgtaggcggtttattgctgctggcaaccggattacgcatctgtggcattaaaatgttcccggtggtcaacatgcttccagcactccttctggcaatgccgctttccgccgcctggaccgcctggtttgcctgacaatgcgtgcaatagcggcaaagtgatgatagattgtgcagtctgcactaaattgaagaaatttgattgacgagacgaggcgaatcaggtttaatgcgccccgttgcccggatagctcagtcggtagagcaggggattgaaatgtggcaagcctgatggattttgctgtgccggtggtggcgtgtctgctggtctggctgttggttaatcgtgggtgaaaaaaggtgagctgtatatgcaacggaggaagaaaccccgttgctggaagccaggaaaaagtatcgggtgttgctgttctcggatgttgtgctaattgggtgataacagatcctgtgtatgggagtttccctttttgcgtgcgttgatgctggtaacggcaaacgtcatgatgaacaaaaccgcgaataagacgacaatcgtcggagctggtgcgctgtcgataaaaaaggacaaccagacaccagtcattgacactattaccgatatgccagtcgccagtaggagcgcaatatgaaagcgttgtgtcaggagtaccgcaatggcgccaggcgcaatgagcagagaaatggagagaatgatacctaccgctttcagcgtcgccacaatggtcatagagaccatgcacagcagcccataatgcagccatctcgtatgcaaaccgcttacctgcgcctgttgataatcaaagctgaacagcaaaaaatctcgccattttacgctaataacaagtgtaaccagcccagcaataatcaccgtctggattatatcgccgatggttatcccgagcatgtcgccgaaaagaatatggtcaagatgtacgtctggtttgactgcaatatacaagatcagacctgcggcaaacatgccagaaaaaacaatccccatcactgtatcttgcttgattcggctgttgtctttcaggtatcccgtcgccaccgcgcagaatactccggcgacgaatgcccctgtagccaaaggtaaccccagaatccaggcaagcacgatgccaggaaaaaccgcatgactcatcgcgtcacccatcagtgcccaacctttcaggaccagaaagaccgacagcagcgcacagggtatggaaactaccagtgaaatcagcagtgcgtgacttataaaggtgaactgcagtggctccagtaataatgccatcatgagcgatcctccagcgccttatgcgcacgccgacgatttgccaaaagcccatgggtgggcgcaaagacaaatgctaaaagaaacagcagtgtctgcgccaccacgatgattccacctgtcgcgccgtccagaaagtaactgacccacgcgccgaggaaactggttacactgccaatagttacagcaatcatgagcaggcggggaaaacgatcggttaacaaccatgctgttgctccgggagtcaccaccagacagatcaccagaaaggcaccaaccgtttgcagcgccgcaacggtcgaaaccgacagcagggtgaagaagaggagttttaatctgcccggatgcaatccaatagcacgggcgtgattctcgtcgaaaaaggtcaccataagatctttccatttgaaaaaaagcacgatgatcgagagaatgccaatgatagtgagttgcaggatatccgccggatcgattgccagaatattgcccaggacgatggtctgaatgttcacagatgtcgggttcaatgacaccataaacagccccaggccaaaaaaggacgagaagatcaggccgatgatggcatcttcttttaagcgggtgcgttggttaagaaacagcatgctgcccgcagccagtccgccggaaaagaaggctcccagagaaaacggaagccccagcatatatgcccccgcaacacccgggacaatagagtgcgacaacgcatcgccaatcagcgaccagccttttagcatcagatagcatgacaggaaagcgcagagaccgccgaccatcgccgagacccacatcgcattgagcatatattcatagctgaagggttccagtagcacgttcatctttcttccctctgcaccgctgacggtcgatgagccacaaaagggcgttcatcgtcagtaataatgctttcttccgagccgttaagtgtgacatggcgcagtacgccgctaaaagccagctccaggttctcggctgtaaaagtggtgtctgtcggcccgcttgccaggacggtgcctttgaccatgaccgtataatcgcaaaatgtcgtgacggatccgagattgtgcgttgagacaagcatcgttttgccttccgcgcgtaactccctcaacaggctgatgattttggcttcggttttcacatcaacgccagtaaaaggttcatccagcaggatcacatcaccctgctgtgcaatcgctctcgccagaaagacgcgtttcttttgtccaccggaaagctcgccgatttgtcgatggcgaaaattcaccatatcgacacgttctagcgcatcggtgacaatttgacgatccctctttttggcgatacgcaacatacccatatgcccatagcggcccatcatcaccacatcttccaccagtacaggaaatgaccagtcaacctcttctgactgagggacgtaggcaaccaggtttttctgtaacgcctgtcgcgtgggaatacccagaacagatatctttccgctggtcagacgcacaaatcccataatcgctttaaacaacgtcgattttccggaaccgtttaccccaaccagagcggcaatagatccacttggtactgtgaaggatgcatcgcgcagtgctgtgtgcccgttacgccaggtgacagcaacatcattaacgacaatgcctgcagattgcatcattatttctcccttttcccggctttaattccctgtaccagcgtactggtagtaaccttaagaaggtcgatatatgtcggtaccgggccgttttctgtgctcagggaatcgacatagagcacaccgccgtagtgtgcgccggtttcacgcgcaacctgacgcgctggtttatcggaaatcgtactctcgctaaagactgccgggatatgatttttcttaactatatcaacaaccttacgtacctgctgcggtgttccttgttgatcggcattaatcggccacagataaagctcttttagccccaaatcgcgtgcgagataagaaaaagccccttcactggtgaccatccaccgctgattctcagggagttccgtaatctgcttacgcaggggggcaagggtttgggtaatcttggctttataagtatcggcattgcgttggtaggtttgtgcatttgccggatcgtattttatcaacgcatcacgaatattatcgacgtaaatcagagcattatctggcgacatccatgcatgggggttaggtttgccctcatagggtccttcggtgatccctacaggcgtcacacccgaagagacaattacttctggaaccccattgagatgctggtaaaagcgttggaaccacaattccagattcataccattggcgagaatcagttgtgccccctgcgcacgtttaatatcgccaggggtaggctgatactcatgaatttctgcaccaggcttggttatagatgagacttctgcagcatctcccgccacgtttttggccatatccgcgatgatggtaaatgttgtaatgaccttgaatttttcagttgcacttgcctgaaatgcgatcgagcaggtgagtgcgaggccccccaagagcatggttactttttttatcgagtgcataatttagtacctatagtgagcaaaattagaacaaacatagcaacggctatgttttatagcacaacctatataaaatgaaaatgattatcattagcaactttgaggcccaaaacagggattaggttgtttcctgctggcgacgtgttattgaggaaaaaagtaaggcagctagtaggctttgaaataacgttctgcggttggctgatgcaatttcgagagtgcatgtattgaatgatttctagctgttactgattttcgtattttttgtatgagatgatttgaacatcctcgcaccaatcttccatgattgctcgtcattgtctctaggactgctatgtgccaggagcggacttttaacaggatttgatgtacggtattgggcgattcgtatagcagcaacgaaaatgagagccagacttatgaactactttattcggccagctacgcctgacgatattaataaaatcatcgaattcaccactcaggaagcgcaagaatcagaaggttcagtgattgaccttgttgctgtggagcgtggtgtatcgtcggcgttcagtgaaaaccctcgttcaaaatattgggtcatggaagattcttcaggaacggtaattgccaatacctctgtcgtaaaagaatggagtgatttccatggtaatgactactggtggattaaaagcttttatatcgccccggagcatcgagggatgggactggctgatgagctcatcaaacatcttataaaagaagccaaatcagaaaaggcacttgagcttcgcttatatgtccatggagataacgggcgtgcgattcgtgcttatgagcgatgtggtttcattgaatctccgtataccattatgaaagtgggtttatagcttccccaaatacagccctcttaatgctctacctgaaatcaggacacaatgccgcaagcggcatctttcattcaaatgatgttcttgaacgttctaggcacataacgacaacttccgctcctcgctcataacgggcgttcatttatggcaaaaaggcttaagtttagaaaacatgcgttttagacgtaaaaaatcatttatttaatcacaacttatgtaatggcataatcaggttggtgaaagagagggcgtaaatggataaaagagctaaaaatcagatagtcgatagcgatattgcacgtttgttactcaagctcagaaagtctcgaaacttgactgttacagagcttgcccaacgatctggtgtcagtcaggcgatgatcagcaaagttgaacgaggcacctcaagccccagtgcaacaatacttagtcggttagctaatgcactgaatattacgctatcaaagctttttgcagagcttgagatgcaacagaattcacttgtacttttggctgaccagcaacaacactggattgatgaagaaacaggtattacccgctggtctttgtccccagcgggtgcatgtccggaactaataaaagttgaaatcccccctatggggcaattgactatccctgcctctgcaaatgagcatctttccggacaaactctatggatgttaaacggcagccttgattttcgagtcaatcatcagactcatcatttacaagccggtgattgtcttgctcttacctttgccagcgagtaccaaatgagaaacccagatagcggccagagttgttcttacattgtcgctttcagtcaaaaaaatccatgatgtaattctcctgaaataatcatgtcacattgccttataaagatgtaatagagggtagggtctgccttgattgtcccgctcggaacgtcctgaaagtttaaagcccatatgttgataaaaacctacagcttgatgattttgttcatttacatcaacgcttagatcaggatgtagagccagcgcatgtgagatcagatgtttcccgacgccaagtccgcgagctgacgcatcaacaaaaagagcctctaaatgtccctcatgcaaaaacatgaatcctagtggctgatcttcctggtttgttgctaccagcacaggggtttctgaaaaaaagctgacaacttctttttcaatctcctgccggtcatgggctgtaagaaaatcgtgtgtggcatcaacggaatttttccaaatttggataatttctggtgcttcagatggtcgcgacattctgatttttaacatgttatctcccttaaagtggtcgttgcttgtgtcttgagatacaaaacgagttatcaaatttactatagtgaaattaaattcacaatagtgatttggttcctgtgccttaacattacccatgaggagtacaattaaacgggttaatcagtttctccatttgaaagaaaatagacttctgtactgtttgatatcaccgctattttcttatttgctgtgcaggtcgtagtgggacaaaactgagacacataaggtctagcaatggcttgcaaggcctcacatgtattgagatgttaataaaatgtagacttgtaattttgatataaatggtagagaaaatctttccccaaaataaaaacgaacgtcaatgaaatcaaacggttgaataaagttgattttggctaataaaaagacaacaaaatgatttttatcattaaatatcaatgagttgaactcatggtttttatatactgctgcgccatatgggctggactgaagccgcagacctgattgttaaaggtatggaaggcgcaatcaacgcgaagaccgtaacctatgacttcgaacgtctgatggaaggcgctaaactgctgaaatgttcagagtttggtgacgcgatcatcaagaacatgtaatctctacatgtgttaaatattgaaacgggcgtataacacgcccgttgtttttataaatatgttaaccgttataaaataacgtatcaaaagtcaagtgaacacatttcaaatatcaatttgatcgtattggtctggtgattatttatggggagcaataaaaagacagtattaatcatccatagggatagtctctgcacttttatttccattatgctaatgccttactgaattatgaagcattttttaagctcccaactttagctagattaatggtttattattttctacatcttcaatatataaaagcgtattatcaatggcgtagtaactgcgtttgttatgattaacatcagtaacccaccggaaaacgccagcgcctgccagtgttgaacagtattcccgaaatgtagattttccgcgaatatgaagcaatgcggcctcttttattttagctgggttcttggtcgtactaacttttaacaggttcctggttcctcttaataacaaaaccgtgtcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttaggtgtgagactgcgtagtgtgcacgatcggttttaccacttcaatctggtctgtcctttggctgtgatatgtacaaagtgtgaaagggggattacctgaattctcccggtgggcattttgcaacggaccagctccgctacaaacgctggtgtgggttcagattataacattctgtctaaggggcgggataaaggtgaatttagggggcatgaaagatgactttataaccttgctcaccccagtgttgtaaaagttcgttttgccttctcgttggtgccatgcctgtccagacaatcaatgtttgcgttgggaacagttccgggcgcggcgattcaatgggatcagcaagaacagaaatgtgccatcctgacaatgataaacgccatgcttccagccacaatcgtgctctctcttcaacattccacgccatcagaatggcctctttaccgggcttacggcgcatttcgaaaagtaaggccgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattcgcgcgcgtagtttggctggattagccatacgaagaattgacatcatctcttcttgcaggcggctccagtcatcttgcgtatcctggctggtagtttccagtaatgctttaactttgcctacaggaacgccattacttatccaacgcttgatctcttcgatgcgttgtatgtcttcttcatcaaagagtcggtgtccgccttcactgcgctgtggttttaacaaaccgtagcggcgttgccaggcccggagagtgacaggattaatcccgcaacgttcagcaacatcaccaatgctgtaataagccacaattcctccttgcggtcataaatctccgtcgcctctacacgacccaataatactttgtacaatatacgctgaaattgtacaaagtataaataagatttcagctaaattggatgaaacattatttttaatgtggattaaattaaaacataacgtattcattttcacgatgatttccagaaatcatgcgaaataatgtgctgaaaattattttttctccggccacgcaactgaagggataccattcaatttagctttggaaaacagatctccctgaaacatctcaattcctgcagattcaagccacatccactcttctggtgttgccacgcccatagcagagacttgaatttcaagtgatgtacagcatttcatgatcgcctgaataattgcctgccgtggtccgcttttatgaacattggtaatcaattcctgactgattttaattctgtcaggctggaagcgtgacaggagtaacaaaccagcaaaacctgcgccaaaatgatcaattgctacactgataccggccgcctttagcgatttaaccgcttcggcaaactcatcaaaccgagatatgacttcactttcagtaaattcaacgatgatttgttcaggtaccagagcattggcctttatttcatcaagtaaaaaagagactgcgtcaggtttgttaaccagggtcataggtaatagattgattgaaatcattttatcaccgagcttaagtgcgtgtgccatcgcaaatgcaagcgccttacttttgagatccgctgtgtagatttcctcgtctttacgctgcccaaccgctatagctgacgggctgtcttcatttttttgcacaatggcttcaaaagcgattatccgccgcgataaagggtcgacaataggatgaaaggcaaagtggtcgtttatatttgatgaaagggtacaagaatcaagttctttatcagatccgtcagcgataaaaagccaggagtcttcagcaggaatctcgaaataggttgattgttcagttgcaaggacaaaagtacgaaaaaattgtagcgctctgtcatcataagttagctgaaattttgatgtgcctttgtcgaatacggcctgtaaaacgtcatctcgctcgtgcaggcgtaaatcaaataattccattcctgctttgccaaaacggcgagcaggcgcgtaatcgcacaacagttcaacaatattatagtgccgtggatcctggcatatggcccgatatatcatttgaacctgttcttccggaccttccagaagctggaaaaaatgagaaccattaaacagtaagatccctgttacgtcagaccgcatgttcctgcgatttgctatcgaaaccatttcttcaatttttttgacaggttcgtcgccacgtatatggctacgataaataagggtggtaagcattaacaatccagggtaatgggcgaggcgagagtaagacggtaacagacatatcttcttgtgtctttcttttaataccaaaacataaccgtttctttacattgataaaaagtggaaaaggttgaagacggtttggcgaaaaaacctgtataggttgtcatttaaatgatgcaatatgttttatcgtaatgcattgttttatatgaattagcactaattgcgaaaaattaatttatcattctgtacacatatttcgtacaagtttgctattgttacctcacttaacattgattaacatttttaacagaggcgtagcatgcatcaaaattcagtgacttcagattctgcaggagcaatcactcgttactttgcaaaagctaacttgcctactcagcaggaaactctcggggaaattgtgactgagattttgaaagatggacgtaatctgagtcgaaagtcgctttgtgccaaacttctttgccggctggaacaagcgacaggggaagaggaacagaaacattataatgcactaattgggttgctttttgaataatgcaacagcctgattatttaacaggttagctatgaagtcgttatgaagacatctgataatgaaagtataaaatatgaaattactggccaggcggtgctccagatactgcgcatgaagataaatttttcgttgcagactcttattaagcaattactcgtaatgaaatcggctgaggaaaatactttccgacgagatttaattgacagcataattcgtgattttagcaacagtgatacaggagggccaaaccgaagaacagcgatagctgacaataaaagtatgttcactggtaagaaaataaacagaatacattaaaatttcataagtaagatgagaggttaccatgcttgaagatactactattcataatgcaatatctgataaagcgttatcaagttactttcgtagttcaggtaatttgttagaagaagagtctgctgtgttagggcaggctgtgaccaatttaatgctttcaggcgataatgttaataataaaaatattatcttaagtctgatacactccctggaaacaacaagtgatattctcaaagctgatgtgattagaaaaacactggaaatcgtgttgcgatacacagctgatgatatgtaacttttaattataaagtataagtttatagaaaactcattcatcttatttttgtctgtcgctttagactatacacagcataattttattggatcactattcctgcgaggctgacatgaataattcaatcccagagagatttatttttcaatgtgctttgtttaaaaatctcgagagggaggtgttcatgacacatggatatgttgatagtcatattattgctcaggctttacgcttgcgtttaaaagatgagaccagtgttattctttctgatctctatctgcaaatcttgcagtacattgaaatgcataagactacactaacggatatcattattaatgacagggaatctgtgctctcttaaaacttgagtaaggtttttgaataaacatcagctgtatcactatgctgatgcaaagtgagcatttcaggcgttatgctttcttaatatatccgcaatatcagagggcaaacaggaatggagagcgctcgttttccattcttgacgcctgatatcccgcctaatttgtttaattctgcctacattgtgctaaaaaattaataggctagatgaagttggagaaaattttatcttcggcgtggatatttgtgatgctctctaccatgctctctgtagaccccagcgcgagcgaatgaacgtctctttagcttctacagacttatcgataaaggctttgggattttgatatttattctgttaatcgcctgcgccgctgccttcctgcttgataggtatttcaataaaagcgcaacgcctgaagagatcctgcgacgggctataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatgcggattaatcgttccgcttacgcaaagcctgatgaatcaggttgccagacagatgaacgctatcgcgagtaaactgccggaaggttttcatattgggattaattttagcgcctcgcatattatttcgccgacgtttgtcgacgagtgcttaaattaccgtgacagttttacccgccgcgatttaaaccttgttctggaagtcaccgagcgtgagccattaaatgttgatgaaagtctggttcagcggttgaacattctgcatgaaaatggttttgtcatcgcgctggatgatttcggtactggttactcagggctttcttatctgcatgacttgcatattgattatatcaaaattgatcatagtttcgttggccgcgtcaacgcagacccagcatcaacccgaattctggattgtgtattggatctggcgcgtaaactttcgatcagtatcgtcgctgaagatgtcgaaacgaaagaacaatttgactatctgaaccaaaataatatcacatttcagcagggttattatttctataaacctgttacatacatcgacctggtcaagattatcctttctaaaccgaaggtgaagattgtggttgagtgaaaattgatcagcaaggccatggtgcggtgtaattatagacagctaattagctcgttgcctcttgttactattgttcattcttttgtttgctataattgtgtgaaagttttgactggattgccattagtagcatgaacaatagtaataatctggattatttcactctctatatcatcttttccattgcatttatgctgatcactctcctggtcatccttattgcaaaacccagcaccgggctgggagaagtgcttgtgacgataaatttgcttaatgccctggtttggctggcgatcaatctggttaatcgattaagggaaagactcgtcagccacagggatcagcactaatctttcagtttctcactgccagtatgcggctgaatgggttgctggcagtgaacccctggatcattgaaggaaaggaattattgcacaaatagttgtcaaccctggtgttatcacagttgttttatatatcagtgaaataatttccatggcaactgttgatgattttgatgtcgaagagttatttgttaaacaaaatagttaccccaaagtgatcaatgtcatgaaaataagctaaaaatgataatgctggcttatttattatttaaatattgtcgctgtttatctatttaaatttcttgtgcttttgtttttatctttgccttccgttttggtaatctgaactcataggttatttgagcaggaatgtttgttaatccaatgaatggatggttaatctatgaaactgaaaaaactccccggatttagtttaggacttattgctctggcggtgggtaatgcatatgtaacacaattgttggatatttatagtataatttcctatataaccgatgaagaatcaccgattgaaatcaaaaataatacttctacaagtaatggggagtatctaatcacttaagacgaaagccatgctgtgaaagtggatgacggtgtaactggatatatacataatgccagtgtgatgactagtggtgatggatcttatggtatttctgttgatagccaaaacaaagtattatatataagcgatagcaatattaagacgctctgaaagcgtatctgacaaagaaaatggagggataacagccagcgcagtagtcagtgaatttggtggcaccatcgttatgaatggtgataattcagtcgagacgagggggcatattcagcgggacttttaagtcagattaatgattctgggactgtggaaaataacaccagtcttgaaaccacagataaaacgaacattgttacctatggggaaaaatgcagtaggagttcttgcatgttcaagtcctggagagtctcgaacatgtgtcgatgctgtagatgatgaagtttgtgattctaacagttacgaagttattagccgtgctgatttaaaaatgaatggtggttccataacaactaatggtattaatagctatggtgcttatgctaatgggaaaaaagcatatattaatttagattatgtggtacttgaaactgtggctgatggaagttatgcagttgctattcgacaaggtaacattgatataaaaaagttctattacaacaaatggcactaaagcccccattgcaaaaatatacaatggtagagagttatttttttccaatgtcacttcagaatcaacagaaacgcctacccccgtcctgcgacccgaagctggcagttacgtcgccaacctggcagccgctaacactctttttgttatgcgtctgaacgatcgtgcaggtgaaacgcgctatatcgatcctgtaactgaacaggagcgttcaagccgattttggctacgtcaaattggcgggcataatgcctggcgtgacagcaacggacagttgagaacgacctcggcacaggccatctggatgggcgtcgatcataatgtgcacacggaagccaatggctcacgtattgagaatgacgcaaataacaatatccagacccgacttggtttccacacctttattcgtactcaggagaaaaacagcggtccgcacggtgacgactttgaaccttttgttgaaatgaacgggatccataacagtaaagattttgctgtctcaataaacggtgtgaaagttgaacaagccggggcgcgtaatctgggggaaatgaaacatggcgtaaatggcaatctgaatcctgcggccagcgtctggggtaatgtgggcgtgcagctgggtgataatggctacaatgacaccgcaatgatggtgggcctgaaatataagttctgatcccgccattagctaaaaaaccgcgtcgaattcatcgacgcggtaacatatgaaatattattttttgccgatagcacgcatggtgtcatcaattgccgtgatcaacagcatttgcggatctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcacaagtaatataggtttctgatggcaaaccgttcttaatattgtagtcctgcgcccaggtcattggtgcgaaaacaaacagacccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcgattcatatccgccatcgctggcgtggagcagaacaatgctgagataagcccgaaggcaagtatttttttcttcaacttagatgtccggtattaagtaagttgcacacacaataatttcgtcttcaattaagatctgcttaactaaagaacgctcgctattattcagataattcaaaatgagcgtgactgtgatgataggaattatgttttttacgggaatgagaataatctcaaatgagaaataactcattgattgacaatatttttattcaagaagtgtcattgactgttaacgcaatgttgtaaaggtaagataatctgatttatcaatattattgtgtgattgttatgtgagcagaagatattcattagcaacgattacattagtcattttattttgtggacggcctcattgtcgaaaaataagcgtacgacagtattatcagaaaagagtgattttttatccaacaacacttcagcgcactgcgtttaaaaaatacctctttcttatacgggatatcatcatttcatcatgatgtctttgatgagcggtgaacacaatacatttgcgctgtctcttcaggatgaatcccctggtctggttcctgcgggctgatgttgcagcagagctaaggtcacttagacgctactatcatttatccaatgcatggaatcgaaatcagtcgatacccgcagtatatatcgtgaactgggcgcaacgctgagttacaacatgcgtctggggaacggtatggaaattgaaccctggctgaaggcggttgtgcgcaaagaatttgtcgatgataatcgagtgaaagtgaatagtgacggtaattttgtcaatgatttgtcgggcagacgtggaatataccaggcaggtattaaagcctcattcagcagtacgttaagcgggcatctcggggtggggtatagccgtggtgccggtgtggagtccccgtggaatgcggtggccggtgtgaactggtcgttctgaccatcaacgattaaactgcgtttcggcgctgtttttgtttaccgggtgctaaaagggaaaattctggggcaaaaaaaagcccgtcagttacggcgggaaacctcatcctatgggagaacaatgaataatgaaattgcggggttatcatctcccaggatacccacgctaacaataaggttatttactcaaccaggcgtaaacattttgttctgtgtgtgggaacagccttaaggtgtaaagggggagggggaaatagcaatgaatagtatcagcaagaatactcgccgctttaccacaacgtggatgagagggatgaaaaactcaaggcagagatgactctgccttgaagataaatgcgcttttacagcgggcttatttcagctcttctgcttccggtaaggtcacgttcagctcaagaatagaaatatcgccatctttttgctcaagctgtacggttaccatctcaggatcaatttgtacatatttacaaatgacctcaagaatatctttacgcaactgcggcagataatgcggttctgcatcgctgcgacggcgttcagcaacaataatctgcaaccgttcttttgcaatgttggctgtgtttttcttccgcgagagaaagaaatcgagtaatgccataatttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaatcggctcttcgccattttctgcgcggcgtgatttcgacgccagaatgcctaaaatacggtcagagtcgcgtactgaggagacttccgggttggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgagtttgcgatgccggaagaatatagagattttcagtacgtttatctttaattaacgcctggtttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgtgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttaccatcggcaatcaattcggcccctgcgctaacgtggcttgtaacaataagatcacattgtggagcataaatacgctgaccggaacgcactggggtatcaattaaacgcgtttttgtgaccggcgttgtattttgcgctggagcctgcggtgcgggagctggacgcggcgctttttcctttccttccgtcaggataggcagccccatcttttcaatttcggctttaagttgcgcatctttgcagccacttacgccaataacccgcaaaccggttgccgaaaccgccttatgcatcgctgaccagtttaccggggcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatcttcagacctgtttaaatatccagtgttgaggcgagtgtattttttcaccacgccaggctttcttaactttccattttttgcagcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcgggcttcaatctcctgcgtgtggcgttgtttgcgacccgtatatttgtgtgagttcagatggcatttccccagagttaacaaggaaatatctcggcgaaaaagccgctgaaaacttacaatcattacaaggctacgatcccagcgaatttacattctctaacggtgtattttgcgatgttaaagaaaaattatgtcgtgatgatcgttattttggtgtgaatggtaagcggagtggaaaaatcaatcaaaccaccacaaagatgttatttatgtgtcgtgagtgatgtcttgtttacattatgttctattcgtcattaacctcttaagcgacagagaggagtggggcgttaacgtttatgacggggagagtccccgtcggttgatatttacttaatttgaatatcgacgttatattttttagttttgtttttacgggcgtcgtttcgggtttgcagcactcgcagctcatatttgccagaagcagggagtgagtattgtccgtgactatcgagttctggggaatatctggataaatcaacagaatcatcgattcctggcccgaagaggtaagtatcagcgccttcattagagatactcacgtgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcaacaatacagccttactgatgcccttaattttcattggtagtctcctgttcagaatgagtacgatgaactgttataatataacaatccttcacgggagaattccagtggctttcctgtgttcggttaaatcccggcgcggcatttttgccggggggattacttataaagggggcatggactgaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattcttccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacacgaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtacccgaagagccagtgctgtttattaaaccagaaacggcactgtgcgatctgcggcagccattggcgatcccatccgatttcggttcagttcatcatgaagtcgaactggcggtgttgattggcgcgacgctgcgtcaggctacggaagagcatgtccgcaaagccattgccggttacggcgtggcgctcgatctgacattgcgtgatgttcagggaaaaatgaagaaagccgggcagccgtgggaaaaggccaaagcgtttgataactcttgtccgctttccgggtttattcccgcggcggagtttaccggcgacccgcaaaatacaacgctgggcctgagcgtaaacggcgagcaacgccagcaaggtacgactgcggacatgatccataaaatcgttccgctgatcgcttatatgagcaagttttttaccctcaaggccggtgacgttgtgctgacaggcacgcctgatggtgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaaggtttacctgcgtggcatccgctacttactggttcgaaagcggcaatgcatggtgaacgtatctctgtgcgtcatatcgcagtaaaagaatcagaagtgattgactggcaggatcatatcttaaataaacctgactgggcgcagtgataaatttaatagatgttgatgggggctttcttaatatacgtctggatgctcgccatttcgtagccctgtttttgaaagcgctctgtcataatgagagttactcgataccttattatcaacaggtaactctcaatctttaaaaaacgtctgtatttttaaatgtgataaactttataccttgagtacatagagagaataatcgcttatcagacttcagatacctcaaagagtgtcttcttaccgtgtcttttctgatactcattacaggtgttaattatttttttggccgcttcttttagtaaagaaagcattaaatcatcataatcaacgtagaatctggttgtttcagtttccgtttttatctccccgatggcggctatttcggtggttaatttcaatttggcggcatcgatatctttattcgcttgtttaaccgtgttagacagggtggtaaagaaactctgcacagattttaacttgttcttcaattctggaatcagtttcccttcaactacgcccgcagcatcttgatgccgtcatccagtaccttaatgagaatgcctttctgggcgaatgcttcgattctattttaaaccaggtgatatttttcctttctgctggatggacgctgtcgcaagaaggccgcgtgagcacaggataagagaacgaaaaatcagcagtctatgcagcgacaaatattgatagcctgaatcagtattgatctgctgacaagaacagactactgtatataaaaacagtataacttcaggcagattattatgttgtttatcaagcctgcggatctccgcgaaattgtgacttttccgctatttagcgatcttgttcagtgtggctttccttcaccggccgcagattacgttgaacagcgcatcgatctgaatcaactgttgatccagcatcccagcgcgacttatttcgtcaaagcaagtggtgattctatgattgatggtgggattagtgacggtgatttactgattgtcgatagcgctattaccgccagccatggtgatattgtcatcgctgctgttgacggtgagtttacggtgaaaaaattgcaactacgcccgacggtacagcttattcctatgaacagtgcgtactcgcccattaccatcagtagcgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggcgttaaaatgggcgatctctggttcaaacaaaaagatctgtttcgtcgctgtggcgtggtttgctttagcagcaattatgagctttacgcagacatgagtaatcgggtgatgtcgacgctggaagaactatcgccccgcgtcgagatttacagtattgatgaggcattctgcgatctgacaggtgtgcataattgtcgcgatctgactgattttggcagagaaattcgcgcaatggtgctacaacgtacccatcttactgttggtgtggggatcgcccagaccaaaacgctggctaagcttgccaatcatgcggcaaaaaaatggcagcggcagacgggcggggtggtggatttatcaaatctggaacgccagcgtaaattaatgtctgctctccccgtggatgaagtctgggggattggacggcggatcagcaaaaaactggacgcgatggggatcaaaaccgttctcgatttggcggattcagatatccggtttatccgtaaacattttaatgtcgtgctcgaaagaacggtgcgtgaactgcgcggtgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgttcaatgaaccttattacggcaatagcgcatcggtaaaactgctgacgcccactcaggacagcagggatatcattaacgccgctacgcgatctctggatgccatctggcaagcgggccatcgctaccaaaaagcgggcgtgatgctgggggatttcttcagtcagggagtcgcgcagctcaatttattcgatgacaacgcaccgcgccccgggagtgagcaattgatggcggtaatggatacgctgaatgctaaagagggcagaggaacactctattttgccgggcaggggatccagcaacaatggcagatgaagcgtgccatgctttcaccatgttatacaacgcgaagttctgatttactgcgggtcaaataaacatagcggcaggaaaaagcgctcccgcaggagcgccgaatggattagcgaccgaacaggtcacgttttttcgctttaaatggctgggaaatcaccaccagcaccgcgacaatcaggtaagcgataaaaataccgagcagccactgcggcatttccagacctaaaaattcccactgacgctcggcgcaatcgccagaggcgacaaacacttgcggcacccatttatccagcggcagccattccgggaaacgagccataaaatcacaggtcgcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccatgcgccccggccatgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggagcaagcgtaaactcgacgcagagcagcccgacgagtgtcaggacgagggtgtaaggcagggccatccacaccatgcggccataagagagacgaatcaatggcgcgagtgcagaggtcagcaggaacaggaacgcagcctgaccgttcggcgtagcgacggagggcagattggtaccggtattaatggcgaccgccagcagctcatattgcttcaacgtgatagcgccactttccattgccgctttcgcttcgttgatataaatcgtccccacgaagacgttatccgaaatggatgacagcagaccgttgaaaatatagaacaacgacagctgagcatgttcagatgcctgcaacacaaactgaataatcggcgaaaacagttgttggtcgataatcaccgcgactactgagaaaaacactgtcaacagtgcggtgaatggcagagattcggtgaaggctttaccgatagcatgttcatcggtaacaccggtcaatgatgtcgccagaataatgactgacaaaccaatcaaaccaacttccgccagatgcagtgccagcgcagtcaccagccagacgccgataatcgcctggacaatcagacggattttatcctgacgggtacgctggttgcggctttgatcgtcaaactgttgcagtacttcgcggactttctccggcagcgtttcaccgtagccaaaccaacgcagcttctctaccagcaggcaggttaacaggccacaaatcagaaccgggacggtcaccggcgacatgcgcaggaagaaatcgccaaaatgccagccagccgctttagcgatgatcaggttctgtggttcgcccaccatggtcatcacgccgcctaatgcggtgccgacaccggcatgcatcatcagactacgcagaaagccacggaactgttccagaaccactttgtaatgcttgtcgatatgactatcgtcttgcaggtcggtatcttcggcacgggaagaggctacgcgatgataaataccataaaaaccgactgcaacgctgatcaccaccgccacgacggttaaggcatcgaggaacgcggagaggaacgccgccgccacgcaaaaagagagcgacagcagcattttggagcgaatacttaacagcaaacgggtaaatatgaacagcaacagctgtttcataaaatagatacccgccaccataaacatcagtaacagcaagacttcaagatttgccgccacctcttcacggacgtgttccgcgctggtcatgccgatgaatactgcttcaatagccaacaaaccaccggggagcagcgggtagcatttcagggccatagccagagtgaaaataaattccgctaccagcaaccagccagcgacgaaagggctgatgaggaaaattaacggatttacgattaagaaaatgatgagggcgagtttgtaccagtcgggggactggcccaaaaaattgcgccatagtgcgcggccccaggagatctccatgatggtttcccttaccttagaaataatcaatgatgtttttatgtttaaacgcaaagcttaacggtcagacaggagtgaggcaagtcttgatagtcaaggggaaagagatgcagaaaatgaagccttgatcccttttttcttctttttgtcttctatcagcgtagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacaacgtctggcacgagatggctggttgaccattcaacacggcaagccgacgaaggtgaataatttctgggaaacctctggtttaaatatccttgaaacactggcgcgactggaccacgaaagtgtgccgcagcttattgataatttgctgtcggtgcgtaccaatatttcaactatttttattcgcaccgcgtttcgtcaacatcccgataaagcgcaggaagtgctggcaaccgctaatgaagtggccgatcacgccgacgcctttgccgagctggattacaacattttccgcggcctggcgtttgcttccggcaacccgatttacggtctgatccttaacgggatgaaagggctgtatacgcgcattggtcgtcactatttcgccaatccggaagcgcgcagtctggcgctgggcttctatcacaaactgtcggcgttgtgcagtgaaggcgcacacgatcaggtatatgaaacagtgcgtcgctatgggcatgagagtggcgagatttggcaccggatgcagaaaaatctgccgggtgatttagccattcagggacgataatccttccagacggatgacaaacgtataattgcctgatgcgctacgcttatcaggcctacgtgtttttttgcaatgtattgaatttgcgatactttgtaggccggataaggcatttacgccgcatccggcaaaaatgagtcctcctcaaacgaggaggactatttacagatttcccattctcggcgggcaacgttccagcaactcgacgctgccgtcttcgttttgctgttccagcatcacatcaaatccccacaggcgatgcacatgcttcagcacttctttgcgcccccgatccagcggtgcgcgattatgtggaatgtaacgcagcgtcagcgaacggtcgccgcgcaaatccacgttccagatctgaatattcggctccagattacttaagttatattgcgacgataaccggttacggatttcccgataaccttcttcattatgaatagcggaaatctccagataattatgccgatcatcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggcgactgacaaatccgtttaatatcctggaacatggcaaacccgagggcatacggattgatgccgctgtaccacgggctgttatagggcggctggaagaccacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacggatagcggcgcgcttcagcaaccgttttctcttcctcgcgcttcggcagggtacgccagagcatattgacctgactttgcagatactcttcgcgactcttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttgaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgcccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagccgtatgttgaataatattttcaactgggttatcaagatgtaattagattattattcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtacgtctggcggaatacagccgtgattgcctgaaagcattgcgcgccgaaaccaatattcagtatgaagggcgtcagggtgggacgctgcaactgttccgtaccgaacaacagtatgaaaacgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgccagctatttacccagaatctggcgcggatggcggagcaggcgggggttaaattccgctttaatacgcccgttgaccaactactttgcgacggcgagcaaatctacggcgtgaagtgtggcgatgaagtgattaaggccgatgcgtatgtgatggcgtttggttcttactcgacggcgatgctcaaaggcatagttgatattccggtgtatcctttgaaaggctactcgctgaccattcccattgcgcaggaagatggtgcgccggtatccaccattcttgatgaaacctacaaaatcgccattacccgtttcgataaccgcattcgtgtcggcggaatggcggaaattgttggctttaacaccgagctgttgcaaccgcgtcgtgaaacgctggagatggtggttcgcgatctctatccacgcggcggtcatgtcgagcaggccacattctggacgggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctcggggcgcacgccagcgatcccgtatgaagatctaagcgtagcgcgctacagccgtggatttacgccatcacgcccgggccatttacatggcgcacacagctaaggaaacgagatgacccgtccgatacaggccagcctcgatctgcaggcattaaaacagaatctgtccattgtccgccaggccgcgccgtacgcgcgcgtctggtcggtggtaaaagcgaacgcttacgggcacggtattgagcgtatctggagcgcgctcggggccaccgatggctttgcattgcttaatctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcaatggcgaatgttggcgaaatgaccctgatgtcgcattttgccgaggcggaacatcctgatggaatttccggcgcgatggcgcgtattgagcaggcggcggaagggctggagtgtcggcgttcgttgtccaattcggcggcgactctgtggcacccggaagcgcattttgactgggttcggcctggtattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcaggatacgccgacggttatccgcgccacgcgcctaccggtacccctgttttagtggacggcgttctcaccatgacggtggggacagtctcgatggatatgctggcggtcgatttaacgccttgcccgcaagcgggtattggtacgccagttgagctgtggggcaaggagatcaaaattgatgatgtcgccgccgctgccggaacggtaggctatgagttgatgtgcgcgctggcgttacgcgtcccggttgtgacggtgtaacttgttatcgctggatgcgaccagcgtcgtatccagcgttataaaacacattaaacttaagattcggcttcttcctccgctacccgaacaccaatcttcaacacttcattatcttctttctcggccaccgtccagatcatcccggcaaactctacctggtcaccgacaaccggtgctgcgcctaacaactgctggacgatttcacccagcgtttgctgcttatcgcgatattctcgcccgtcttccaggccatatatcagcgccacatcagcatatttggcgctggcttcgagaatgaagtcaccaaagaagcgttgatccagcgcgaccggcggcgactggctgaacagtttaccgagcgccgggagatcgcgttcccgaccaattacacacaacacatcgccttcgcgcagtcgggtgctgccggtgggatgaagcaactggttatcacgaaacagtgccgcaatacgcgtctcttttggcatatgcaaatcacgcagtgccgcgcccacgcaccatttatcggcactcaattgataaacaaactgctcccacggattttccggatgaatatccaggccaacgcgtgacaccggacgtcccactggcggaacgaccactttggcttttttcgccgcccacgagagtgatgttccctgcaatagcagtgaaaccaggaccacaaagaaggcgacattaaagaacagtcgcgcattctccagccccgccatcatcgggaacacagccagaataatcggcaccgcgccgcgtaatcctacccagctgataaacacgcgctcacgcagattgaagccacggaacggtagcaatccggcaaataccgaaagaggacgggcgaagaaaatcatccatgcggacaaaatgagcgccggaatggcaataggcagcagatcgcttgggttaaccaatagccccagcaccaggaacatggcgatttgcgccagccaggcgaggccgtcgaaattttgcaggatgccgtagcggttgcgaatcggccgattacccagcagaaaaccgcacagataaacagccagaataccgctgccttccagcgccgtggttaaagcaaaaattaaaataccgccgcttaatgccagcaatggatataatccggcgggcagggcgatgcgattaatcatttgcagcagtaaataaccaccgccaagcccgatgacaatcccgaggccaaattgctgcagaatatcgaccacgaacatccagctgacactgctttcatgctgctggatcatcgcaatcagggtaatcgtcagaaagaccgccattggatcattactgccggattcaatttccagcgtcgagccaacacgttcgttaagccccttaccacccagcagagaaaagaccgctgcagcatcggtggagccgacgatagcgccgattaataatccttcaatcaaatcaagattaaacagccacgccgccatcatgccggttaaaccagaggtgataagcacgcccagcgtcgccagcgacagtgccggtcctaacgccacacgaaaggaactggcctgagtgcgcatcccgccgtcgagcaaaataatcgccagcgccaggttacttaccatgtaggcgaagggataattatcaaacgggataccgccgacgccatcaacccccgccagcatgccgatcgccagaaaaataaccagaatgggaatgccaagacgggaagaaaatgaactaagtaaaatactgctggtgacaaggatggatcctaagatgaaaaggctaattattgttgtggcatccaacggtcggttactcctgattacgctgtctcttatataaaccctaccatattagcggcagagacagcgttttacttagccctgaagcgtgatttttttacattttaagaacaggatgaccgctaatcgtcaactgagtgccttcctgggtgttattcagaatggcatgtgcgcccaacggcagcgtaaccgtgcgttgttcatgaccaaaatcgaggccggtaatgagtggaatcgacaggcgggaacgcaaaaacgcgtacactgactccaggttgtaacctgcgtcataatcattaggcgtgctgccgctaaagctaccgagaataatcgccttctgacgtggcaaaattccagcatgatagagctgcaacagcatacgttcgacgcggaaagggtgctcgttaatatcttccagcaccagaataccgttctcaatttttggcatccacggtgtaccaatcagtgaaatcagcatcgcaagattgcctccccacagcgtgccttcggtctgacatgtcgggccttccccttgccattcaatggtgaacgttttattgcgtaacgccagccagaagtggtgctcggtaaaggcatttagttcatccgcgccaaagtttgctaccagcatggggccgctaaaggtgatgacattgccttgcgccagaagaccgcactgaatggcggtaaaatcgctatgtccgcaaatgagtaacgggtcatgttgttggcgagccaccagtgcctgccagtcaatatctgccagtaaacgactggcaccgtaaccgccgcgtacagccagcacgatggtgttgggggtagtcagtctggcaagagaattgagatcttccagacgctccgtttccgtacccgcaaaacgctcacaacgacgggcaataacctcgacgttattgacctgatgccccgcgtcggtaaggcgctggataccacgcagcgcggcgtgctgtttaatgcagtaacccgatggggcaattaagtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagataaaagcttcaacctccggacgtgatgtatatcgtcgtatgggctggagcggtgagccgacgaccagcgagctgaaaaatccggagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatctggatgctgatgagttcctcgatcacgtagcgcgaaatcatcctgcgccgcaggctccgcgctatatctacaaacttgagcaggcactggacgcgatgtaaatcagtcgcgcacattgtccgcttttttccgggcttctcgctcgagagagaaaataatccgctgtaattgccgctccaccgtcgggctgacgttaagaaaacggaagctcagacggggagtggtgatggtttcatttttgccatcaatcactttgcgctcgctgatggagattaactgggcgtcaaagtgaaaaacaccccattgccccatgttgacttcaatctgagcgaagcgcatgccttcgtgtaattcggcaggctttgctgtttccagtaatgcgcccatgccgcctaacgacaaatcatacaggcggaaacgtaacgtactgttatccgccagtttggtctggcaaaaataaggcggatggagtggggcggtgatgcggaaatatcggcgtcgttgtacaaaccataaggtgggaggcggtacggtaataaatgccggaagctgcaagtattcactctgctgtagttgttcaacagtaaactcgactttcgcaccctgagtttcggcggtaatggtaatgtgctgcgcctttagcacggcgatgttgtcttcggcctggctgccgaaatccagcaccagtttatccggagttattgccagtattttgctgatcagctgcccgccattccagctgatacgcaaaggaattgcggctttgtgcaaatcgcgtaacacgcccaggacggctaacggattttgtttcaggaactgctcatggtaatgactcacgcggaaaaactcctgactgacaaactgtctttggtttatcggtcgcagttaacaaaacttaatacaaatgcgcgaatactttttacatgttgttcttaaatcagccgacatacgcccagcatcgatcccgcccttgcctatacttagagcgttgacgtaagcatttcttgcgtccaattcatcgaaacgagggcctgaacatgggaattattgcctggattatttttggcctgatagccggtattatcgccaagctaatcatgccggggcgtgatggtggtggatttttcctgacctgtattcttgggatagtcggtgcggtggtcggcggctggctggcgaccatgtttggcattggcggctccatcagcggttttaatttgcacagcttcctggtggcggtggtgggcgctatcctggtgctgggcgtattccgcctcctgcgaagagaataagattttcataaggcggatagcgatacagatgccgctatccgctttcacatcagaacgtatactcgatacctgcccagaaattgcgaccttcttcaataaacccttcactgtaggcatatttggtatcaaacaggttattgaccgacgcattgacgctgaagccatgacctaaggtgtaatcggctcgaatgtgagtcaccgcaaaaccggcggctttttgtgaaccgtcactgttgctgtagctggaggaacgcgcctcttccgacagcgttacgcttaacggctcccacggtttgagagtcatccatgcggtcattgtctgcgttggcagatcggttatcttgccgatgtctttgcgtttggcatcagcgtggatcagggcgtagctcaatcctacatccagtatattgctgattttccccttaataccggcatccagaccgctgtaatccaccgtgccgctgttctgattttgaatggtatcggcatcgatattgtgcgagaggatggcatcactcacccggttatagtaaacgctgacctcaaatccccagtcgtgcgtgaaggcaccattccaggttaaatccaccccgcgcgcgcgttccggcttgagctgcgggttaacaatcgctatctggttatacgcaggtttggacgtggtatagcgttctttcagcgtcggaaagcgtgtgcggtcatagtacgaaagcgccagcgtgtcttcattggcaaagtggtatttccccatcacctgccagttaaaagctgactgattgttgtcgtcataatgggtgatactgccatctttctcatgttttttcgcttctacgctatcgcgccagtcatagctgattccagccacgacatcgacattatcggcagcagcccattgatattcactggcgagcgaccaggtacgatcttcatagcgatcgtaagcggcgtgcggcgcacctttttcccggtgtacgtcatctttccagttaacggcaaacgacagcagatcgttttcacgcacatcggctgccagttgtaacccggcaccgtcgctgtaatcggaataatggctgtagctgccttttttatttttcaaatcagccagcgagttgtacatcattagcgtattttcaaaggtgtcgtgatacagccgacttttcagggtaaaacgatcgtttagttgggtcgttccctgataataaaaactttctttgtcatactctggccactgccagtagcgtgatttctgaccactatttccactgtatggcgggttatctttttcaccatcctgcttaatgtaagtcaatgtgtattcatcgttttcgcgtggtgtaaaaccgagcttcacaatgccgcgtttatcatcagccgatgaattaatcatcttgccgtgtttgcctgcaatatcattatttacaccatgcggcaggccgagaaaatcctgctttagctggctaccgctgacttgcaaataccccagatcgctgctggcggcaaatgaagcatgcatatcgtaggcattgtcctggctacggctccatccctggcgatatcccagactggcttccagaggttttgttggcttctgggtggtgatattaatggctccgcccatctgattaggcccctgaagcagcgacgaataccctttggaaacttcaactgcccccaaattgttggtcagaatccgcgccagatcgaggttgccgtcatagggaacataaatgggcacaccgtcgaaatagaccggcacctgacgactatcaaagccacgaactttgacctgttcttcgttgcggctacctgacttttgcagcaccacgccggggacgacacttaatgcctgagcgacattctgtttatccagggccttcatggtgggttgatcgagaacggtggtcgtcgttgatgataccggactggaccatacggtcagcgtgtcgctctcctgagccgctacggcctgctgggtaaaggcaagtgataatactgtgcagagataacgttttttgagtctcatagaataaattccgtttaacaaagaattaaatagaggctgcgggttgcagactgactttaatgtcagcaggtgccgcgtaataaggcgcggaggtaataaaaaggcgaatgccgcagtcgaggtaatttttgagtgttgtcagattaattccgccggtcagagccagcgtgcagtggggagccagcgacggtgctatttgcgcaatttcagttgcctgttgcggactaaatttgtcgagctgaagtacgtctggttgcgcgcgtaacgcggcgattgcctctttcggcgtgtcggcttcaacaactattttcttctcgggtgcgtggcgacgtaactgattgattgcgcctgaccagtcctgattgtcatgaagaaaatggcggtggttggcaaacaataatatggtttccgcacatccggcacgatgaatcagtcctccggcagccagaattgcctgcgaggccagtaagcgggtgcccggaattgcttttcgggtgcaggcgatattgccatcagggtaacgttcacgaagtaacgccagcatttgagcgagataatcagaaacaccgcaactccactccagcacattctggactgccttccatccctgatgaagtgctgcggcattaccttgcgcacggattagccgctgacccgcgttcgcttgtgaaccgtcgctgaccgcgtcatcaatagttaatcccagcgtagttaacatcttacacgcgacagaaattccgctgacgcagccgccctgacggagaaaaaactctatatagccatgctggtgtccaatatttaatgctcgcgtggtcaggtcaccgccctggatatcttccagaagtaacgcatcgatttgtgcctgagaaaggaaaatcatcgcagtgtctcctgcggtacgctatcccaccagatgagcgcccagtcgcggctggcaggggcgagggcacgagcatcttgttgttgataccagcgatataaccgctcacgctcatcgtcgttaagcgcgcccagactccagctgacgttctgctcaaaacgttcccaggtgctgttatcctgttggcaattttgtccacggataaaatcaacgtgagcataaattcccatctgatacaggacgttgagtgcaaagatatagttgggtaattcgatcacttcccgaccagccgcccgctgaatggctggagagacgaacgaggtgctgaccagatgagtcgtatagacgcgaagccgtgcctgattattcagtttgctcattgcctggcgcatatcagccaccagagtggagcgggaagccacggcaatatcgcagcgtggcaggtcactccagtcctcttcccaggcgcgctggatccagtggacattgtctgcctttagcgcggcggcgcgacgggcggcaacgttcagcatcccctgactgtaatcaacgccataaatcgtcgtgagtttgtccgccagcgccagcgatacggtacccggtccgcagcccatatcgaataaggtttgcgcgccttgcaggtcaatttttgaggtcagttgttgcaggtagctgtccgtaggcgaggcgcaattttccgccattttttccgcccgttgatcccagtgatccggcgttttttctgtgcgatgggccagcctgagttgctgaaggtaaaggtctgcaaaatcaatatcgtcaatgagcatgatttttccttagtgcttaattgcagagaggtgatggtgaatctggtcggcagaaacccggtacagggcagccagttttttcgttgttaactgttcggtcggtaagccttgtgttactcgtccatctggctctacctggataatgctgtcggcaatggcgtttgcatggagcggatgatgagtcgacattaacattgtcatgccgttatttttgagctgcgccagcgtgtccagaagttggatctgatgaccgaaatcgaggctggaggcaggctcatccagtaataacaagcgcggttgctggacgagtgcacgggcgattaaagccagctgacgttcaccgccgctaagcgtattccagcgtcgtgtcgccagatgcaaaatgcccagcttttccagttgctccgttgctttcaggcgttcttgcttaccgggaacggaaaaagcgcctatggtgggggccaggcccatcaacaccatatccagcacactaaaagcaaaaatgccgtcgtgcgcctgcggcacccaggcaatagcctgcgcgcgctggcgatggctgagtgtctgcacagagaggctatccagtaagatctcgccttttaataacggtataacgccaagaatggagcgcatgagtgtggttttgccgcaaccattggctcctaacagacaacaaattgttccttgcgacagggtgaaggacacgtcgcgtagcaccggatggcgggagtaacccagagacgcatgacggacggcaagcaaagtcactggcgacctccgcgtaacaacaaaaacaggaaaaacggtgcaccaacaaaagcggtcagaatgccaagtgggatttctgttgttccaatgctgcgtgccagcgtatcggtaagcaggagcagaatcgcgccagtacacattgccatgggcaacagctgctgatggttatgaccggtcaacaagcgggcaatgtgcggaacgaccaggccgacccaaccaattatgcccgctattgctaccgtgctggcggtgatgagtgtggcgcagaaaattaatccaaagcgcagacgtgtcacgttcagtcccagcgaacgggcttcgtcgtcggaaagcgtgagtaaattcatgcgccagcggagaaaaaacaggggcaaggagcctatgagaatgatcggtgcagcatagcagagatcgcgtaaggtcacggtggacagcccccccagcaaccagaaggtaattgacggtaactgggtgtaaggatcggccagcgtttttattagcgatatccccgctccgcacaacgttcctaacgcaatgcctaccagcaccagggttaagatcggatcgtggcgggtcacccgacgcgtaatcaaccagacgcccgcgaccaccatcagcccgccgcaaaatgcgtacagctggatgtaaacaatggataatccccacaggattgccgcgcaggcaccaagtccggcaccggcggagacgcctaaaatatccggtgacactaagggattacggaacattccctgataggtggttccggcccctgccagcgccgcgcccagaaacagcgcagcaagaatacgcggcacgcggatttgccagaagacaatttgttcttgcacaggaacattttcttgacgaagaatgagcgccagcagttgctgcatatcgagatgataagccccacttacggcggcaaaagtgatactgatagctgccagcagcaaaatacatccgtttacggttctcattagctcgccaccaatttttgatagtcggcgtcactgagtgaacaatgccagaacagttgggcgtaatgctgcatgtcacttttaaactggcgattgatggcgggatccagccaggcgtgaagtctgcgtaatcccagaagacggttgattcccggcggggcatccagccagccaaagggcaggccacttaaaaataagatgcgttgttccgcaaccgctttcacgccctgccagagaggatcacgacgaataaaatctgcagtaacggcctcctgaaccagaataatatccggctgccagcgcaggagattttccatggaaacctgtgtcagaccgtggcgatcggctatttgcgcgacgttatgcaaacctaataattccgccgcctcggtatgcaacgaaccctgtaagcccgtttccagccctcgaggaccgcgcgcagcataaaagctgaggttagcggcgggtgaggtggcgaatgcctgagcttcaccaacgaagcggctggcgagattggcttgttctgcggcgcggtgctcttcgcctaacgttttgccaagcgttgttaactgttctgctgattgttccagtttcccgttaagcaataaccagggtatttgtgtctgttcgctaacctgccgtgcctgggagatccaggtttcatccgtattgccgcaatcaacgaccaaatcgggatgtaacgccataagcccttccagcgagagtgtgctggcgcgcccggcgagtcgtcccagcctggggaactggcgaatgtgctctggcaatggaattaatgcctgacgggcaaaatcaaaagaggaaaaaccgaccattttttctggcgcgacagccagcaatagtaaatcggcgggcgcgcctgcgctgacgatgcgtgtaatgttttgggcttcgggaagcgtccgtgaggcccagaatttgactgattgtgcaaaggacggcagatgatgcaggaacaatgtcgacgcaagaatctgtgtaaacctccgtctggttagtgacataagtaatatcctgataattaaaaccgctatatacttacacatatagcgaaaaagatcatgtttgatgtcaaaatttgtctaaagagacagaatgatttgcttgttgcttaaataacactttgttccacaagaaaattgtcagggagaatggggagtgggggaaaatataaatagaggtgtaatgattaacaagttgataaaataaaattaaactcttctctaataaaagaaaataaaggcatagaccgtagaaagagtggtatttggtatttcgtgatgaagaaagagcaatgccaattttatgcacgtaatggcattgctcgatatacagtaaagttaaggcgtaggttccgcctctttttgttttagcggctgtgttgttgattcactgagtggacgcgtcgccggaacattgtcacacggttgctctttcgggcagatcaaatccagcattttcagcgtcacgccattggtccagccaaagccatcctgtaatggatattcgccaccgccgccccctgttccggtggtgctgacatcatatttttccaccagctttttctcccggtcataggtgtgctgaacattggtcaggaagtgccagctaatgtccatcgctacctctttttgcccgtagttttgtaatccttctgtcgcgacccactgcaacggtgcccagccgtttggcgcatcccattgttgcccacttttcaccgacgtggtgttcaggccgcctggttgcagcagatgtgttttcgtcgccgtcgccattttgctggcgcgatctttcgctgccgcattgacgtacagcgggaacagggcggccgcggttaactgattgcgcactttatgacttttcaggtcgtaatcggcataccagccttgttgatcgttccacaggtatttttcgatccctttttgacgggcatttgccagcgtttcgtactggtttgccatcgcgttatctccggcagctttgctggcgcgggagaggattttttccattttgaacatcaagctgttcagatcgaccggtacgatgctggtggtgcgtaaggtgtttaactgctgcggattgtccatccagcgcgagctgaaatcccagccagacgcagcggcagagcgcaggtcgcggtaaatttcagtggcaggtcgattcggattgcttttggcagtggcaatatcttccacccatgactctggtcgtggcgtatcgcgatcgtcccagtagcggttgagaagggtaccatcctgaagttttacaacgcgtttttcctgttgtccggcttgcaggttttcaacaccgtccatccagtaagcatattctttttgcatttgcggcaggtattgtttcaacgcggcgtcgccttcatgctgcgccagtaactctaccatcagggcaaagaagggcggttgcgagcggcttaaatagtaactgcggttgccgttgggaatatgaccgtaagtgtctatttcatgagcaaaattggccaccatatccgcgactttatcccagtgaccgctttcggcaagtcctaacatggtgaagtaactgtcccagtaatatacctcgcgaaaacgtccgccgggcacgacataaggttttggcagcggtaatagagaatcccatttttcggtgttttcggtagaacgcgttaataccggccaaagtccgtcaatatgttcgcgcagtgattgcccctctggcggaacatatttctcgccctctttcggcagggtgaaattgacgttaacgaaatggcgtagatcaaatccgctctggttttgctgcatccgataatcagcaaggatcatcagcggatcgctgttcggcacggcatcggcaaaggttttttggtccggaaaaagtttggcgttttgcacatcattaaacagcggccctaataaaatatcaggcggttgtggtgttaccgatgtttcttctgcctgcaccgatagcgcagcgaaacacaaaaagatgcaggctggaattaacgccattttttgcgggcgagaaggtgcgggggatttcatcagtcattctcctttggcgaaaccgaataaaacggtattcaagtatcagaaaaccttagttcaggatcgcactagctgcatgatcgaaatcacattctgcgaactgacagacattttagaaaagggaattaaagggataaataacggcgaaatagagtgataaaataacatctgtttattagtcagccagcgacgttgggttcgcgattagcgaagaaaaatcatcataatttggtgaaaaatataacaggtagtaaaaaaacatcagtgcagagtaaattgccggatgacatcagaatgatgccatccgaacggtggtttaaccctgacggttgaaacgttgcgttttaacgtccagcgttagcgtttcttctggttgtatcgcatacagtttctcaccctgctggcaaatccagccaattcccagttcacgggcgattagggcactgtgggatagcggacttccggcgctaaggcagataccttttacaaccgctggatccagttgcagtactgtggagggataaatgttctccgccagtagaatagttggcgagttaaactgcgggagttcttctttcgtttgggtcaggtggaccagggtgcgatgcagaagatcgtccacatcgatatagcgagcctgtagatattcatcatccagctgttggtattgctggctaagttctttaagaacttgctgccaggcatattccgccgtgcaatgttcatgctgaaggagttcgcttgccgccgcctgcagttccggatcatctaacagtgtatggtgaccagaaaagattgcggcaatatcgtcaagcccactggtttctgctttcgctgttaacgtcatcagatctaataacgtgaagtcaatggcctggcgtaatcgttcttgttcttcttccacggtcagggttgattttgcctgtaccgtacataaaacaggttgataataaaaggctttacccgaaacaggcggaacgggacgcagagtaggtggagcaacttcctccgtttcaccaaagttatcttcagccagctgacggaaagcgatcagtgcctcttcagcttctggtcctttcgcaatcaggcgcagcgtatcgttatagcgaacttgtagtaacgcaatctggttaatactctccggtgtaacgcatttgccgtttttctccagcaacatatcggcattaaatgtcgataaggtataaaccagccgggaggccggacgtacatgcaggccgttacggttttttatgaccaccgacagagaacgggcttcttcatcgtacggaggacatgtgtcagagatttcagtgtcggaggacggtaaacccagttgttcacgtttggcttccagcgcatgcatggcgtcaaagataactttgtcgatatccgctcccgaggccgcgctgaccgctgctgccagtgtaccttcgaccaacggcgcagcacacaaacgtacttttgcggcgatctcgggagccagcaattccagcgcagtttcagcactcaataatgcgctacccatatccatcatgaccagcacatggtcggcatcggcaacagattcgatggcctccatcactttgacggcatcggtaccaatgggattatgtggatcgtcaattcccgcggcaatggcgattttacaactatcactcattaacatctgacgggctaattcaccgacaccttctcccagtcggctgctatgtgaaactatgaccaggtttaccatcaccaattccttactcttttgcggctaacgccaacatttgcatcataaacatcaccgaggtcgcgccgggatcctggtgaccaatactgcgttcaccgagataactggcgcggcctttgcgggcttgcatcgtaatcgtactttgtgcagcggattcggcgatgctactggcagcgtcgagcgccgccggaacagggagattttgctcgcaggactgacgtaacgattccaccaccggcacccacacatcacacatggttttatcgccaggttcggctttcccgcgactgattacgccgtccgcgccatcgcggaacatctgataaagctcttccagcgtcaggctttgccgtgcctgggttgtctgtgcggcgcggataaagaaggtaccgaacagcggaccactggcacctccgacgctggaaagtagcgtcatgccggtattcttgagaatgaaaccgatatctttatctgcgatagcagggagtttttccaccactttgctaaagcctcgattcatatttagcccgtggtcagcgtcgccaatctcgcgatccagtccagtaagatactcgctctcggtgctgaaaatatcgccacaacgagtgagccagttaacaatttgagttctgctcagtgacattgctttctccttatttaccccagttaagggccggggtgtggacaggggcgtcccagagtgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgtggttcttcctgccagctgccttgttgataatcccagaaacgcaaagtgcgatggtatgagccattttccagcagggtgtcgaacatttcatcgacggtttgatcaagggaagagaaggggcggcggtcaatacctggctcaccatgaatgccgacgccaaactccatctcattatccgccagggtaaaagaaggtttgcccgcggcaggaacggtacaggcaccgagagcgatacctattgaatggccttgattattcaacttacgccccagttccgcacaggcgtccagtgagtcgccacgctccgccgctgcacctacgagtttttcaattaatacggtgttggcaacgccgcgccgcccggcggtataaagactgtcttttactgcaacgtcgtcatcaatgaccacagtggtcacttttacgccgctatcgtgcagtaactcggttgctgtttcgaagttaagaatatcgccggtgtaatttttgataatcaacagtacaccttcgccgccatcaatttgcatggcgcattcaaagattttatcgggcgtcggtgaggtgaaaatttcgcccggacaggctcccgaaagcatcccctgaccgatatagccacagtgcatcggctcgtgtccgctgccgccacccgacagcagggcgactttccctgcaacgggggcatcagctcgggtgacatacaccggatcctgatgcagtgtcagcgatggatgcgccttcgctagtcctgccagttgttcgtccagtacgtcttgcacatcattgatcaattttttcattattttgctccagcaattacggtagggcatggatgatgttcaacgacacggcgaccactgactgccgatgaatccattgtgcatcaggcaagggaaaagaaaattagcccaaattaggtttcatagtgaaacatatgctttaatgaatgttccatattgaaacttttacgtgtattaatacttaaaattgcgagccggaacaccttttgtcataagggatgcgggatatgagtggcgcttttaacaacgatggtcggggcatatctcccttaattgcaacctcctgggagagatgcaataagctgatgaaacgggagacatggaacgtaccacaccaggctcagggcgtgacatttgcttctatttatcggcgtaagaaagcgatgctgacgctcgggcaggctgcgctggaagatgcctgggaatatatggcaccgcgagagtgtgcgttgcttatcctcgatgaaaccgcctgcattctcagccgtaatggcgatccgcaaaccttgcagcaactaagtacactgggattcaatgacggcacgtattgcgccgagggaattattggtacttgtgcgctatcgttagcggctatctctggtcaggccgtgaaaacgatggccgatcaacatttcaaacaggcactctggaactgggccttttgcgcaacgccgttgtttgacagcaagggccgattgacgggaacaatagcgctggcgtgtccggttgagcaaactaccgcagctgatttgccgttgacgttggcaatcgcacgcgaggtcggaaatttactgctgacggacagtttgctcgctgaaactaaccgtcatttaaatcaacttaatgccctgttagaaagtatggatgatggcgtgattagctgggacgagcagggtaatttgcaatttatcaatgcccaggcggcgcgggtcttgcgccttgacgcgacggcaagtcagggacgagcaatcactgaactcttaacgttacccgccgtattgcaacaagcaataaaacagtcacatccgctcaaacacgtagaagccacctttgaaagtcagcatcagtttattgatgcggtgataacccttaaaccgataatagaaacgcagggaaccagctttattttattgctccatcctgtggaacagatgcggcagttaatgaccagtcaattaggaaaagtcagccataccttcgctcatatgccacaggacgatccgcaaacccgccgcttgattcattttggtcgccaggcggcacgcagtagctttcctgtcctgctttgtggagaagagggcgtgggcaaggcactgctaagtcaggcaattcataatgaaagcgagcgtgcagcggggccttatatcgccgtcaattgtgagttatatggtgatgcggcgctggcggaagaatttattggtggcgatcgcacggatagtgaaaatggccgtctgagtcggctggaactggcgcacggcggcacgctgtttcttgaaaagattgaatatctggcggtggagttacagtctgccttgcttcaggttatcaagcagggggttatcacgcgactggatgcgcggcgtttaatacccattgatgtcaaagtgattgccacaacgaccgcggacctcgcaatgctggtggaacaaaatcgttttagtcgccagctgtattacgcgctgcatgcatttgaaattaccatcccgccactgcgtatgcggcgtggcagcattccggcgctggtgaataacaaattacgcagccttgaaaaacgcttctctacacggctgaaaattgatgacgatgccctcgctcgcctggtttcctgtgcatggcctggcaacgattttgaactttacagcgtcatcgagaatcttgctctgagtagtgataatgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttgggatcggccgcactacgctgtggcggaaaatgaagcaacatggcattgatgcagggcagtttaagcgccgtggatagcgggagagtatgtactttcccgctatgaattgctaattaatagcgaccatgactgccgtgatttggtccaccatttgaaggtggcattggcttacctgagggcgcaggaccacgagggccatcgctgtggcggtgatgatggtggggaacacaagcactcaacaggcttgcaaagacaattgctaacaggctgaaggtaaatgtttttttcatgacaaactcttgaacggttaatgcactgtgattgttatcacataaaagctgcattgttaatattgtcaggagtctgattatgagttttggtaactcagaattgaaagaagacgcgtagcaggcgtaaaaaagccattacgtgcaactcacataatggctcgttattaaccgccagggtagtattagcggaattagacgttgaacaggaagttcatcacatcgccatctttaacgatgtaatctttgccttctgcacgcattttgcctgcttctttcgcgccttgttcacctttgtaagtgatgaaatcttcaaacgagatggtttgtgcacggataaagcctttttcaaaatcagtatggattttgcccgctgcctgcggcgcggttgcaccaaccggaatggtccatgcacgcacttctttcaccccagcggtgaagtaagtttgcaggttcagcagcttataaccggcacggatcacacggttcaggcccggctcttccagcccaagctcctgcataaactcgtcacgctcttcgtcgtccagttcggcaatgtctgcttcaacagcagcacaaaccggaactacaacagaaccttctttcgctgcgatttcacgcacctggtcaagatacgggttgttttcaaaaccgtcttcgttgacgttggcgatgtacattgttggttttagcgtcaggaagctcaggtaacgaacagccgctttctcttcagcgcttaaatccagcgcacgcagcatacctgcgttttccagctggggcaggcatttttccagtaccgccagctcggctttcgcgtctttatcgccacctttggctttcttctgtacgcgatgaatcgcacgttcacaggtgtcgagatccgccagcgccagttcggtgttgataacttcaatatcatccgccgggttaactttgccggaaacgtgaatgatgttgtcattttcaaagcagcgaacaacgtgaccgatcgcttcggtttcacggatgttggtcaggaactggttacccagaccttcgcctttcgatgcgccttttaccagaccggcgatatcgacaaattccatggtcgtgggaagtgtacgctgcggttttacgatttcagccagttgatccaggcgagggtcaggcattggtacgacgcccgtgttcggctcgatggtgcagaatggaaagttggccgcttcaataccggctttggtcagcgcgttgaacagggtagatttcccgacgttgggcaaaccgacgataccgcatttgaatcccatgatttaaatcaccttaatatcttaataatcaacctgttattgctaacagattgcagaaatggaaataactttgcctattatacacggcactcggcaaaaatgccgcagacaacgacttattgcgctttaaaggcgtgcaatcggttcgttgctttggtcaagccatctgtaaaccacatttcagtacaacgcgccgcttcgtcgatggcttcatcaattaacttctgttcactaacaggcggtttgcctaacacaaaaccgacaactttatttttatcgcccggatgaccgattccgatgcgtaaacggtgaaagttagggttattacccaatttactgatgatgtctttcagtccattgtgaccaccatgaccgccacccaacttaaatttggcgacgccaggaggcagatccagttcgtcgtgggccaccagaatttcgtccggattaatgcggaaaaaactggccatcgccgcaacggctttgccgctgagattcataaatgtagtcgggactaacaggcggacatcttcgcctccaagggtgactcgcgaagtataaccaaagaatttagcctcttcgcgcagcggagcgcgcaatcgctctgccagtaagtcaacgaaccaggcaccagcattatgtcgcgttgcggcgtattcagcaccggggttcgccaggccgacaatcaatttaatcgtcacgtttttttgtcctgagtgtgtacataactggcgcgtagtttactggttgcggccccgcttgacaaaaaactgcgtatcaaatgcagataacgcaattattgcctgagtgaactattagaaagtcaaggtgttcaggcgtttatttgtaaagttttgttgaaataaggggtgtaattgtgatcacacccgcacataacctacagggtgttgtctatactttacacataaggaagaggggtattccctgttacaacccagaaagttccggaggtgacatatgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgcagtgctaagtattttcgtcggtgcgattctctggctggcaggtgcccgtgttggcgggcatgaacaggtgtgcgaccgttactggtgggttcgccactatgacaaacgttgccgccgtagcgataatcgccgtcatagctaacaaataatgcagtttgctgaccagtcagtttgcgctgactggtcaatctcgtacttataaatccgccatcgccgcgcgacgattcgggaagaatgcgaggcgtcccgggatcggttgaatgcctgcgcgagccatagtgcgcagtggctggaattccaggttgcacacgcgcagttcacatccttcgggcagacgcttcacaaaacgctggaacgcatcaagaccaccagcatcaagtaccggaactgcatcccacttcagaatcacaatccgtttgccttcaagacgtgactccaggtccgtgaataagccttcagcggcagcaaaaaacagcgggccaataacgcgcagaaccaggacatcgtctggaacgtctacgactaccggtgccaggcgagtcatacgtgcgatacgacgcataaacagcagcgatgccagcacgatccccacgctgatggcaataaccatatcgaacagcacggtcagcgacatgcacagcagcatgacgatgatgtcatctttcggtgcatgacgcagcaagtcgaccactttgtgcgcttcactcatgttccacgccaccatcaacagcagggctgccatggcggaaagcggcagccaggagagcagcggtgccagtaccagcagggcaagaataaccagaatagagtggatcaccgccgagataggggaagtagccccggcacggacgttagcggcagaacgcgcgatggcagctgtagcggtaataccaccaaagaacggagcgataatattccccagtccctgtccaaccagttcgctgttcgccttgtgtttcgtcccggtcataccatccagcaccacggcgcagagcagagattcgattgcgccgagcattgccattgagaatgccgcaggcagcaaggtgcgaatagaatcccaggttagcgtgaattctgaattaggcagatcccacggcagcaccagttgcggcagcagttgcggaataccgttaccctgagaaccatcggccaggacgtagtggaattgcgaaccgatggtagcaacatgtccgccgagcaggttaacaatccccatcaccgcgcaaccagccagcaaggccggaaggtggccgggtaaacgtatgcccagacgcggccagaaaaccagaatgccaagcgtcacaatgccaatggctgcatcacccacattaatggtcggcagcgccataaataatgcgccgactttttgtagataatgttccgggacatgggccatttgcagaccgagaaaatctttaatctgcatggtaccgatggtgatcccgatacccgaggtgaaacctaaggtgacggaaaccggaatatactcaatcaggcgaccaaagcgtgccagccccatcagaatcaaaaagatccccgacagcaaggtcgcaaccagcagtcctgccagtccaaactgttgcgaaacgggatagagaattaccacaaatgccgcagtcggaccggaaacgctaaagcgtgacccccccgtcagagcaatgacaatccccgcaacagctgcggtatataaaccgtactggggggccacaccactaccaatagccaacgccatcgccagcgggatagcaataatcccgacggttatcccggcaatcaggtcacgggtaaaccgtgcggcagtatatttttctttccagcaagcgtcgatcagagcgcggaaaggcatcacatgtgaggaaaatattttgttcacaataatgtttcatccgtgagcgcatcatctgtcaactaaatggcaggtgaaggaggcataggtcatacaaatggatattacagacaaaaaaacccgccgcagcgggtctttgagccgggttcgattagtgttcgaacatggcagagatcgattcttcgttgctgatacgacgaatcgcttcggccagcatacctgacagggtcagagtacgcacgttcggcagtgatttgatttcatcgctcagcggaatggtatcgcagacaacgacttcatcaattacagagttacgcaggttgttcgccgcgttgccagagaagatcgggtgagtcgcgtacgcaaatacacgtttagcaccacgttctttcagagcttcagcagctttacacagcgtaccgccagtgtcgatcatatcatcgaccagtacgcagtcacgacctgcaacgtcaccgatgatatgcatcacctgggaaacgttcgcacgcggacgacgtttgtcgatgattgccatatcggtatcgttcagcagcttagcgatagcgcgggcacgcacaacgccgccgatgtccggagaaaccacaattgggttatccagattcagctgcagcatgtcttccagcaggatcgggctaccaaatacgttatcaaccggaacgtcgaagaaaccctgaatctgttcagcgtgcagatccactgtcagcacacggtcaacaccgacgctggagaggaagtctgcaaccactttcgcagtgattggtacacgagcggaacggacgcgacggtcctggcgcgcatagccaaagtaggggataacagcggtgatacgacctgcggaagcacgacgcagggcatcaaccataacgactaattccatcaggttgtcgttagtaggggcacaagtggactggatgatgaaaatatcaccaccgcgtacattttcattaatttgtacactgacttcgccgtcgctaaagcgacctacagcggcgtcgccgagtgaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcatgattctttccaggcggtgtattaaagagcgcgatgcaacgtctggaacaaggtgacgttgtcaccgaaactcagcttgcccggcttaaagcatggctctgtgcaatggggaaagattaacgcctttcgccacaaagccattgagccattccggggcttgctctagcacctggcgggcttcagactctgtatcaaattcagcaaagacacaggcccctgtcccagtcaggcgcgacggggcgtattctaacagccaggaaagcaccgcatcaacctcgcgaaaacgttttcttgcgataacctcgcaatcattgctgaattcacattttagcaacgtttctattgacctttttggcgtattgcgcgggagttcaggatctttaaaaatcaccggcgtcggaatactcacgccagggtgtgcgaccagataccatttctctggcgggtctaccggcgttaatatttcgccaacaccttcggcaaaggcggcatgaccacggacaaagacaggaacatctgcgcccagcgtcagccccatttccgccagctcatccatgcttagtccgcattgccagagatgatttaacgccaccagaaccgtcgcggcattggatgaaccaccgccgagaccgccgcccatcggcaaacgcttgtcaatgctgatattcgcaccgcttcccgtcgaaagacgcccgctgtctgccgcagttttcatcaacaacctcgctgcgcgaacgatcaggttatcttcatgttccacgccttcaacgggcgttaacagacgaatatccccatcgtcacgaagctcaatgctgatggtgtcgccgtaatcaagaaactgaaacagcgtttgcagcgtgtggtaaccatccgcacgctgaccggtaatgtataaaaacagattaagttttgccggagagggccactgtgtccgcattatttcactatccagttatccatttttaacttgatgcgttgaccaccgtcggtgagttccatattggctggcatcgcaggttgagtttttgtgtcataaccaccgtaaacaactttccagtttttgccattctggctgtaggtgatttcactcaggcggtactggtcgtcaagattgtagtcagtcgcatcacccggtaaacctaaaatccactggcgcaagctgttgagcggaattggcattccggtcaatttgccaatcatctcttcggcgtcatcggaggtataacgctgacctttattgtcgactaactgcacgttacccggttgagcattcagctccagttccgtgctgcccaatgggttagtcagcagcagacggtagcgatcctggccagtttgttgccagaagaaacgggcgtacactttttgttggtcagaaatataagcgaacgcgccgcgagtttgatactgattaagattgcgcacgtcttgctgatgctgacgccattgtggcgaatccgggcttttgccaggacctttgggcgtggtaacggaacaggcagtgagcacaagagcagccagcggtagcaggcggataaagcgaaaatcgggcaggggcataataatgacaagtccttgagatacgttgcagttataacccttaatgctagcgttaccgttagccatcgtctatgttcacgttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggtgtggtgctgtcgacgtgtaaccgcacagaactttatctcagcgttgaagaacgggatgacctgcaagaggcgctcattcgctggttgtgtgattaccataatctcaacgaagacgatctgcgtaatagcctctactggcatcaggataacgatgcggtcagtcatttaatgcgcgttgccagtgggcttgattctctcgtccttggcgagccgcagatcctcggtcaggttaaaaaagcgtttgccgattcgcaaaaaggtcatatgaaggccagcgaactggaacgcatgttccagaaatctttctctgtcgcgaaacgcgttcgcactgaaacagatatcggtgccagtgctgtgtctgtcgcttttgcggcttgtacgctggcgcggcagatctttgaatcgctctctacggtgacggtactgctggttggcgcgggcgaaaccatcgagctggtggcgcgtcatctgcgcgaacacaaagtacagaagatgattatcgccaatcgcactcgcgaacgtgcccaaattctggcagatgaggttggcgcggaagtgattgccctgagcgatatcgacgaacgtctgcgcgaagccgatatcatcatcagttccaccgccagcccgttgccgattatcggtaaaggcatggtggagcgcgcattaaaaagccgtcgcaatcaaccaatgctgctggtggatattgccgttccgcgcgatgttgagccggaagttggtaaactggcgaatgcttatctttatagcgttgacgatctgcaaagcattatttcgcacaacctggcgcaacggaaagctgctgctgtggaggcggaaactatcgtcgcccaggaggccagtgaatttatggcatggcttcgagcacaaagcgccagcgaaactattcgcgattatcgtagccaggcagagcaggttcgtgatgagttaactgctaaagcgttagcggcccttgaacagggcggtgatgcgcaaaccattatgcaggatctggcatggaaactgactaaccgcctgatccatgcaccaacaaaatcacttcaacaggctgcccgtgacggggataacgaacgcctgaatattctgcgcgacagcctcgggctggagtagcagtacatcattttctttttttacagggtgcatttacgcctatgaagccttctatcgttgccaaactggaagccctgcatgaacgccatgaagaagttcaggcgctgctgggtgatgcgcaaaccatcgctgaccaggaacgttttcgcgcattatctcgtgaatatgcgcagttaagtgatgtttcgcgctgttttaccgactggcaacaggttcaggaagatatcgaaaccgcacagatgatgctcgacgatcctgaaatgcgtgagatggcgcaggatgaactgcgcgaagctaaagaaaaaagcgagcaactggaacagcaattacaggttctgttactaccaaaagatcctgatgacgaacgtaacgccttcctcgaagtccgtgccggaaccggcggcgacgaagcggcgctgttcgctggcgatctgttccgtatgtacagccgttacgccgaagcccgccgctggcgtgtagaaatcatgagcgccagcgagggtgaacatggtggttataaagagatcatcgccaaaattagcggtgatggtgtatatggtcgtttgaaattcgaatctggcggtcatcgcgtgcagcgtgttcctgctacggaatcgcagggtcgtattcatacttctgcttgtaccgttgcggtaatgccagaactgcctgatgcagaactgccggacatcaacccagcagatttgcgcattgatactttccgctcgtcaggggcgggtggtcagcacgttaacaccaccgattcggcaattcgtattactcacttgccgaccgggattgttgttgaatgtcaggacgaacgttcacaacataaaaacaaagctaaagcactttctgtactcggtgctcgcatccacgctgctgaaatggcaaaacggcaacaggccgaagcgtctacccgtcgtaacctgctggggagtggcgatcgcagcgaccgtaaccgtacttacaacttcccgcaggggcgcgttaccgatcaccgcatcaacctgacgctctaccgcctggatgaagtgatggaaggtaagctggatatgctgattgaaccgattatccaggaacatcaggccgaccaactggcggcgttgtccgagcaggaataatggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacgcgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgctggcgctggccagcgagcgtccggactgcgaaattaccgctgtagatcgtatgccagatgctgtctctctggcgcaacgtaatgcccagcatctggctatcaaaaatatccacattctgcaaagcgactggtttagcgcgctagccgggcagcagtttgcgatgattgtcagcaatccgccgtatattgacgagcaggacccacatcttcaacaaggcgatgtccgctttgagccgctcactgcgctggttgcggcagacagtggaatggcagacatcgtgcatatcatcgaacagtcgcgtaacgcgctggtatccggcggctttctgcttctggagcatggctggcagcagggtgaagcggtgcgacaggcatttatcttcgcggggtatcatgacgtcgaaacctgccgtgactatggggataacgagcgcgtaacgctcggccgctattatcaatgacaagtttttctacgttgcttagcgttcatctcattagtatcgcgctttctgttgggctattgaccttacgtttctggctacgttatcagaagcatccacgggcatttgctcgctggacgcgcattgtgccgccggttgtcgatacgctgttattgttaagcggcattgcgttgatggctaaagcgcacatccagccattttccgggcaggcacagtggctgactgaaaagctgtttggagttatcatttatattgttttgggttttattgcactcgattatcgtcgtatgcacagtcagcaggcgcgcattattgccttcccgctggcgttggtggtgctgtacatcatcattaaactcgccaccacaaaagtaccgttactggggtaagtcatgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaattagccagcttctgccattagaagagcagctagaaaaattaatcgcgctgttttacggcgaatgggggtttaaagcctcacgcggcgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagctgatattgcgcattgaatgtccggatggcgaaatttggctgattaatccttttaacggtgaatcgttaagcgaacatatgctggatgtgtggttaaagggaaatatcagcccgtcggcggaactgttttatgaagaccttgatgaagctgataacattgaggtaatccgcaaattgctggatacactcaaagcttcgttgatggaagaaaatcagatggagctggcgttacgcaccagcgaagctttattacaattcaacccggaagatccctatgaaattcgcgatcgcgggttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaattaatcgacattttactcaagattaaggcgatcctatgaaacaaaaagtggttagcattggcgacatcaacgtagcaaatgacctgccgttcgtactgtttggcggtatgaacgtgctggaatctcgcgatctggcgatgcgcatttgcgagcactacttaaccgtgacccagaaactgggtatcccttacgtgttcaaagcctcttttgacaaagccaaccgctcctccatccactcttatcgtggaccgggcctggaagaagggatgaaaatcttccaggagttgaagcagacttttggcgtgaaaattatcaccgacgttcacgaaccaagtcaggcacagcccgttgctgatgtcgtggatgtgattcagttgccggcgtttcttgctcgccagactgacctggttgaagccatggcgaaaaccggtgcggtaattaacgtcaagaaaccgcagtttgtcagcccgggacagatgggtaatatcgttgataaattcaaagaaggcggcaacgaaaaagtgattctttgcgatcgcggtgctaacttcggctatgacaacctggttgttgatatgctgggcttcagcatcatgaagaaagtgtctggtaattcgccggtgattttcgacgttacccacgcactgcaatgtcgcgatccatttggcgcagcttccggcggtcgccgtgctcaggtggctgagctggcaagagccggtatggcggtaggtctggcggggctgtttattgaagcgcatccggatccggaacatgcgaaatgtgatggtccatccgcgctgccgctggctaaactggaaccgttcctcaagcaaatgaaagcgattgatgatctggtgaaaggtttcgaagaactggataccagcaagtaatctttttgtttgaaaaataaagtcttagcgttctgcgttaagactttttttatgggggccggatacaaaaaaggccgcaggctgttacccctgcggccggtttcgggcgcatattgccatcacggcagcctgacgcccgttttcaccttacttccggttacgccaccagccgacaatcgctgcggtaataattcccgccaggatcggtgctgccaggtcgtgccagaaaatcatggcaaactgcgcgagcgtcatatagccgccttgttgtaatgacaacattttgcggctattcttgaattgttgatggttcaagattagcccccgttctgttgtcaggttttacctctcaacgtgcgggggttttctctttccagcaaccaatgccaccagggataaagcccccgcaacattgcgcctcaccggataacgccggcttggtgtggatactcgtcgcaattcatcttcacttcatccctgaaatgtttgcattgaagagtacattccggcttttcaacagctgttgcagtggtttcgtgcaggttgtggtacaggctcgcaattctgattaacgacctgtccaggtagtatgaagaaatacaataagcaggaatttatattatctcccccgatttccgtcatcggaggagatataactgtcaggcaaatatcgtcatcaaataggcggcaaacagtgccagatgcgctgcgccattgagcacgttagttcgtccggtggagaaggagatatggcacagtactaaagaggccaccatcaccaccatttctggcgcaccaagtgcaaactgcaattcgttacccgtcataaaggcaattagcgtgacgacaggtacggtaagcgaaatggttgccaacactgaaccaaagaacagattcatcgcgcgctggacctggttattcaacactgcttttaacgcacctaaaccttccggcgacagaatcaacagagccaccaggaagccagtaaaggcgacaggcgcattcatgctgtcgagcaatgtctccagcgggctggcgttcattttggtgactgcaataacggcaatcagatggacaattaaccagatggcatgccacaggctgctatgggcagacggtttaccgtggtgcgggtcgtcatcatcactgtcatcttcgtgctcgtagacaaacaaactttgatgcgttttggtctggatcagcaaaaatacgccatacattgccgcagaaattaatgctaccagtaacgcctgacctgttgaaaaattcgccgcaggcagcgccattggaaataccagtacgattatcgccagggggaacagcgcaattaaatactgcttgataccaaacagattcatatattgggtggcaaacttacgtccgcccaacaataatgaaaagccaaccagcccacctgtaacaatcataatgattgaatagagcgtatcacgcattagcgttggcgcggcgtcgccggttgccattaaagctgaaatcaaactgacttcaagaataaccactgaaaggctaagaataagcgaaccgtaaggttctcccaggcgatgggctaatacgtccgcatgacggacaacactaaaggcgctacttaaaataccaataagcgcaagaagattgatggcaatgaccactggtagtgtctggctgcttccccacaggaacagcactaccagcgccagaaccgggaaaataagcgaagtctccttgtggcgggtttttaccgcctcttgagcatttgacattatggttatccctttgcagatgaatttatcgaaaatgtaaaaaataggtaggaaaaataacagaaagtgtctggatatcggtaacattttacgaatttttaccccgctgtcgattttttactcatttgggcataaaaataagtaatacgtttagacaatgtttgttttagcacttcttaagaagagtctgacatgaaaattcttatgttttggcaagagtagatattgttgaccacacttaatgttcaactttgtaaaaggagtcaacgatgccgtataaaacgaaaagcgatctgccggaaagcgtaaagcacgtgcttccgtctcatgcccaggatatctataaagaagcgttcaacagcgcatgggatcaatataaagataaagaagatcggcgtgatgacgccagtcgcgaagaaacagcgcataaagtggcctgggctgctgtgaagcatgaatatgccaaaggggatgatgataaatggcataaaaaatcgtaaaaccggtagcttagttaaagctattcgtgcggtgttgccttgcaagtggtccgtggattgcatattgtcccgttagtggtttcaaaatgagcagtaaaaatgtccggaagacaccaaaaagttgtcgcagggaagtatgcagtggcggaggtgtaaggtgataacgcgtgatttcttgatgaatgccgattgtaaaacggcatttggtgccattgaagaatcactcttatggtcagcagaacaacgggcggcttcgctggcggcgacgctggcttgtcgacctgatgagggaccggtgtggatcttcggttatggatcgttgatgtggaatccggcactggagtttaccgagtcgtgcaccggtacactggttggatggcatcgcgcgttttgcctgcgcctgaccgccgggcgcgggactgcgcaccagccgggacgaatgcttgcactgaaagagggcggacgcaccacaggcgtcgcctatcgactgccagaagagacgctggagcaggaactaaccctgctgtggaagcgcgagatgattaccggctgttatctgccaacctggtgtcagcttgatcttgatgatggacgcacagtaaacgccattgtgtttattatggacccgcgacatccagaatatgaatctgacactcgcgctcaggtcatagcgccgttgattgcggcggcgagcggtccgctgggaaccaatgcacaatacctgttttcactggaacaggagcttatcaaactgggaatgcaggacgatgggctgaatgaattgctggtatcggtaaaaaaactgctggcggagaattatccggatggtgtgttacggccgggattcgcctgagtaaactttcctcatagtggggcgtcagacgccccctcaaacattaaaatgtgagcactttatcggctgacagcgtccattgcgccagttcaacaagagtaccgatttccaccccatcaatcagaggaagtgtactaatcccgcgcccgtcggtacaggttttgcacaatttcaccggtacattctgagcggtaaggatctccagcatttgctgaatgttgtagccttcccctggtttttgcccgcgcaacccggctgtgaccgcatcagacatcaggaacagacgcagatccagattgttctcctgctctcgtaacgcaatggccagccgcaagctgttaaacaaggattcgctcccgtaaggtgcgccattggcaacgatcacgattttttgcattatttactcctgtattcagggaattagacactcatcttctatcttactgcttctgcagcgtctgaccaatcggtcacatttttaaggattttcctgaaagcgcgagaaaatacgacaaaaggtgccagtaatcgttattctttaaggctatggtttttcatttttaccggaagttaccgacgttttgagccgtttcgttcctcgcattattccgttttatttactcttgctggcggcaggcggtacagctaacgcacaatctaccttcgagcaaaaagcggcaaatccctttgataataacaatgatggtctgccggatttaggcatggcacctgaaaatcatgatggggaaaaacactttgctgaaattgtgaaagatttcggcgaaaccagtatgaatgataacgggctggatactggcgagcaggcaaaagctttcgcattgggaaaggtccgcgacgcgcttagtcaacaggttaatcagcacgtagagtcctggctatcaccgtggggaaatgccagtgttgacgtcaaagtggataacgaaggacatttcaccggcagtcgtggaagctggtttgtgccgttacaagataatgatcgttatctcacctggagccagcttggtcttactcagcaggatgatgggctggtgagcaatgtgggcgttgggcaacgctgggcgcgcggcagctggctggtgggttataacactttttatgacaacttgctggacgaaaatcttcagcgagcgggcttcggtgccgaagcgtggggcgaatatttgcgactatcggcaaacttttatcagccgtttgctgcatggcatgaacagacagccacgcaggaacaacggatggcgcgcgggtacgacctgacagcccgaatgcgcatgccgttctatcaacacctcaataccagtgtcagcgtagaacagtattttggtgatcgtgttgatttgtttaactctggtacgggttatcacaatcccgtcgcgttgagtctgggattaaattataccccagtgccattagtcactgtgacggctcagcataaacagggtgaaagtggcgagaatcaaaataacctcgggctgaatcttaactaccgctttggtgtaccgctcaaaaaacaactttctgcgggcgaagttgccgaaagtcagtcgttacgtggtagtcgctatgacaatccgcagcgaaataatcttccgactcttgagtaccgacagcgaaaaaccttaacggtgtttctggcgacaccgccgtgggatctaaaaccaggcgaaacagtgccgctgaaattacaaatccgcagtcgttacggtattcggcaactgatttggcagggcgatacgcagatattaagtttgacgccgggcgcacaagccaacagcgtggagggctggacgctgatcatgcctgactggcagaacggggaaggggcgagcaatcactggcgattgtcggtggtggtggaagataaccaggggcagcgtgtctcctccaatgagatcacgctaacgcttgtcgaaccgttcgatgcattgtcaaacgacgaactgcgctgggaaccgtaatcagaaaatgcgctcctgatgcacccataccgctgcttccacgcgagacttgagcttcattttcttcagcatgtgcttgacgtgcacttttactgtgctttcggtgatatccaggcggcgggcaatcatcttgttcggcaaaccctgggcaatcagcttgagaatatcgcgctcgcgtggggttaactggttaacgtcgcgctcagtagtggcacggtttgcgcgcaagctggcggccagaacaggcgttaatgcttcgcttaataccatttcgccagcagctgcctgatgtaacgctttcagcagatcttccggttccatatcttttaacagatagccatccgcgccgcgtttcagtgcggtgaccacatcttcttcatggttagagacgctgaataccacaatgcgccctgagagggacttttcgcggagtttatccagcgtttccagaccattcatgccgggcatattgagatctaacaggatcagatcgggatcaagagattccgccagttcaataccctgttcgccattactcgcttcgccaaccacagtgatatctggtgccatactgataagctgttttacgccagttcgcaacatcgggtgatcgtcgatcagcaggatagtagccggttcctgattactcatgggtatctccttggacgtctgtgaaagttttttcgggaataaaggtgaccaccacttcggtgccacctgattcacgacggcggacgcggcaatcgcctcgtaaactttgcgcacggtcgcgcattattatcatgccgtagtgattgctgcggatggcattttcaggcacgccgcagccgttatcctggacggtcagtttgacctgattatcgttttgcgccaccgtcaccacgacctcactcgcttgcgaatgtttgagggcgttacttaatgcctcacgggcaatttgcaacaagtggattgcctgatgcgaaggcaccagacgaggcggcaattgataatccagcttcaccgggaagccaaatttggcgctgtactcttcgcaactcgcctccagcgccggacgtaatccaggctcggtgagctgcaaacggaatgtggtgagcaattcacgcaactgcgcccaggatgcattcagttcgttacggatctgacttaacagttcgcggctgctttctggcagcgcatcgccctgcatctgtaaacaactcacctgcatcttcatgcaagagagagattgggcaatagaatcatgcagttcgcgcgcaatggtggcacgctcttccatcacgatcaactgttgctgacgttcctgatggcgatccagcgccagcgtggcggtgagttgttcaaccagggtatccaccagttgttgttgatcatggctaagatgacgcccctgcggcagggtcgccagcaaaataccgtactgcgtatgagagtcagccagccgccacttcagggttgtgccgcgatcgccaacgggtaatatgccgcgcgggcagagctggcagcctttatcatcacaagtcatatctggctggcaggtaaactcctgatgattctcttcatcatcagtgtcatacacccgcagttcgatatcacgtagcagggttaaattctgtaagccgttgagtaccggtgacaggcgttcacacagcggggcgcgggaatgcaaacggcggttagcctgccataaaaaagagaggatctgatttttatgctccagcccggcagttttctcctgaacccgctgctcaagtacggcataactttcggccagttctgcagacatattgttcaatgcagttccaagcatcgccatttcgttgcgcccgctgatgtttgcgcgttgggtaaaatcgcgatggctgacggcactcgccattgccagcagttgccgccacggttgtagcagtcgcgcccgcaaccagataatagtgaacaccagtaaaagtgccataaataccgccattacccgatggaccagtaccactgtctcaatgcgcatttccgtggtgcggtcaaaaccagataccagctgatcaagcccggcaacaaactggctgacatccgctgacaccgtttcgcggttttgtgcacgcatcagcgcggggatcagttcattacgccagtaatcttgtaaaccctgtaattgcgccagttgtccgtctcgttccgctgctcgagtcaactcggcgctaaatgccgtttgttccatttctttaattaagggcttgtctttctcgcttaatggcactgccgccaacagacggtaactttgcatgcgcagcgatcccgctttgttgatcgcatgggcgctgccctgaacgccttgcaccagccagccagaaactgccatccctgccagtccaatagcagtagaaagcaacacaataagcgcaacctgattaaccagggtgagcggagagagacaacgtttaagcatgtaaacctcttccttcaggctttaaatgagcaataaccttaatgaatgtgacgatacattctggaatggcagtattctcggctattggctgaagtatacccatacccggaaagagttactccttatttgccgcgtggttagtcgctttacatcggtaagggtagggattttacagcaccgtgaaaaatctcataatttttatgaaatcactgtactcactatgggtaatgataaatatcaatgatagataaagttatcttatcgtttgatttacatcaaattgcctttagctacagacactaaggtggcagacatcgaaacgagtatcagaggtgtctatgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacttaccgaaagtcggttttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatctctctgctgtgcggctttgctggcgcgaacttcgcatccagtatggcaaacatcagcttcttctttccgaaacagaagcagggtggcgcgctgggtctgaatggtggtctgggcaacatgggcgtcagcgtcatgcagttggttgctccgctggtggtatcactgtcgattttcgcagtatttggtagccagggtgtcaaacagcctgatgggactgagctgtatctggcgaatgcgtcctgggtatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggttccttcatcggcttctccgcgggctttgcgatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttatcctgatggcgattttcagcggcctgctgttcctgaccttaccgactgacggacagggcggaagcttcatggcgttcttcgcagtcttcctggcgctgttcctgacagctgggctgggtagtggttccacattccagatgatttccgtgatcttccgtaaactgacaatggatcgcgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaagtatttttgattttctatatcgcctgcgtggtgattacctgggcggtatatggtcggcattctaaaaaataaatcgtaatatttgattatcctttgcgcggcatgatgtcgcgctttttttatgcgtcatttagttacaacatactaatgttgtatggcttatttcgctggatttcattaagagtcattaatatgttacccatggggaatactccttaatacccatctgcataaaaatcttaatggtttaaataaccacaggtgtaaaacgtcttaatttacagtctgttatgctataaatgttaattatcctaaaggggtattccaggaatttactttatttttcatccccatcactcttgatcgttatcaattcccacgctgtttcagagcgttaccttgcccttaaacattagcaatgtcgatttatcagagggccgacaggctcccacaggagaaaaccgatgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgaactcgcccggacctgccaaaccatgaacctcgcggctgcccgcgcggtgccagctactcctggtatctttacagcgctaaccgcctgaaatacccgatgatgcgcaaacgcctgatgaaaatgtggcgtgaagcgaaggcgctgcatagcgatccggttgaggcatgggcttctattattgaagacgccgataaagcgaaaagctttaagcaggcgcgtggacgcggtggttttgttcgttcttcctggcaggaagtgaacgaactgatcgccgcatctaacgtttacaccatcaaaaattacggcccggaccgtgtcgctggcttctcgccaattccggcaatgtcgatggtttcttacgcatcgggtgcgcgctatctctcgctgattggcggtacttgcttaagcttctacgactggtactgcgacctgcctcctgcgtctccgcaaacctggggtgagcaaactgacgtaccggaatctgctgactggtacaactccagctacatcatcgcctggggttcaaacgtgccgcagacgcgtaccccggatgctcacttctttactgaagtgcgttacaaaggaaccaaaactgttgccgtcacaccagactacgctgaaatcgccaaactgtgcgatctgtggctggcaccgaaacagggcaccgatgcggcaatggcgctggcaatgggtcacgtaatgctgcgtgaattccacctcgacaacccaagccagtatttcaccgactatgtgcgccgctacaccgacatgccgatgctggtgatgctggaagagcgcgacggttactacgctgcgggtcgtatgctgcgcgctgctgatctggtggatgcactgggccaggaaaacaatccggaatggaaaactgtcgcctttaataccaatggtgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtgggcttcccgtactttggtggcgatggcacggaacacttcaacaaagtggaactggaaaacgtgctgctgcataagctgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttacacccctgcctgggcagagcagattaccggcgtttctcgcagccagattattcgcatcgcccgtgaatttgccgataacgctgataaaacgcacggtcgttcgatgattatcgtcggcgctgggctgaaccactggtatcacctggacatgaactatcgtggtctgatcaacatgctgattttctgcggttgtgtcggtcagagcgggggcggctgggcgcactatgtaggtcaggaaaaactgcgtccgcaaaccggctggcagccgctggcgtttgccctcgactggcagcgtccggcgcgtcacatgaacagtacctcttatttctataaccactccagccagtggcgttatgaaaccgtgactgcggaagaactgctgtcgccgatggcggataaatctcgctataccggacacttgatcgactttaacgtccgtgcagaacgcatgggctggctgccgtctgcgccgcagttaggcactaacccgctgactatcgctcgcgaagcagaaaaagccgggatgaatccggtggactatacggtgaaatccctgaaagagggttctatccgtttcgctgcggaacagccggaaaacggtaaaaaccacccgcgtaatctgttcatctggcgttctaacctgctcggttcttccggtaaaggtcatgagtttatgctcaagtacctgctggggacggagcacggtatccagggcaaagacctggggcagcagggcggcgtgaagccggaagaagtggactggcaggacaacggtctggaaggcaagctggatctggtggtgacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgttggtcatctgggtaaagaaactgacatcgtcacgctgcctatccagcacgactctgccgctgaactggcgcaaccgctggatgtgaaagactggaaaaaaggcgaatgcgacctgatcccaggtaaaaccgcaccgcacattatggtcgtagagcgcgattatccggcaacttacgaacgctttacctctatcggcccgctgatggagaaaatcggtaacggcggtaaagggattgcctggaacacccagagcgagatggatctgctgcgtaagctcaactacaccaaagcggaaggtccggcaaaaggccagccgatgctcaataccgcaattgatgcggcagagatgatcctgacgctggcaccggaaaccaacggtcaggtagctgtaaaagcctgggctgctctgagcgagtttaccggccgtgaccatacgcatctggcgctgaataaagaagacgagaagattcgcttccgcgatattcaggcacagccgcgcaaaatcatctccagcccgacgtggtctggccttgaagatgaacacgtttcttacaacgccggttacaccaacgttcacgagctgatcccgtggcgtacgctctctggccgtcagcagctgtatcaggatcaccaatggatgcgtgatttcggtgaaagcctgctggtttatcgtccgccgatcgacacccgttcggtgaaagaagtgatgggccagaaatccaatggcaacccggaaaaagcgctcaacttcctgacgccacaccagaagtggggtatccactccacctacagcgacaacctgctgatgctgactttaggtcgcggtggtccggtggtctggctgagtgaagccgatgccaaagagctgggtatcgccgataacgactggattgaagtcttcaacagcaacggtgcactgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatatggctttaactactacggcaccgtaggttctaaccgcgatgagtttgttgtagtgcgtaagatgaagaacattgactggttagatggcgaaggcaatgaccaggtacaggagagcgtaaaatgaaaattcgttcacaagtcggcatggtgctgaatctcgataagtgcatcggctgccacacctgttcagtgacctgtaaaaacgtctggaccagccgtgaaggcgtggaatacgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgattatcagaacctgcataccgcgccggaaggcagcaaatcacagccgattgcccgtccgcgttcactgattaccggcgaacggatggcgaaaatcgaaaaagggccgaactgggaagatgacctgggcggtgagtttgacaagctggcgaaagacaagaacttcgacaacatccagaaggcgatgtatagccagttcgaaaacaccttcatgatgtatttgccgcgcctgtgcgaacactgtctgaacccggcatgtgtggcgacctgcccgagcggtgcgatttacaagcgtgaagaagatggcatcgtcctgatcgaccaggataaatgccgtggctggcgtatgtgcatcaccggatgcccgtacaaaaaaatctacttcaactggaagagcggtaagtctgagaagtgcatcttctgctatccgcgtattgaagccggccagccgacaatatgttcagaaacctgtgtcggtcgtatccgttatcttggcgtgctgctgtacgatgccgacgcgattgaacgtgcggcaagtaccgagaacgagaaagatctctaccagcgtcagctggatgtgttcctcgatccgaacgatccgaaagtcatcgagcaggcgattaaagacggtattccgctgagcgttattgaggctgcacagcagtcgccagtttataaaatggcgatggaatggaaactggcgctgccgctgcatccggaatatcgcacactgccgatggtctggtacgtgccgcctctgtcgccgattcagtctgcggcagacgcgggtgaactgggcagcaacggcattctgccagacgtcgaaagcctgcgtattccggtacagtatctggcgaatctgctgaccgccggtgataccaaaccggtactgcgcgcgctgaaacgtatgctggcgatgcgtcattacaaacgtgctgaaaccgttgacggtaaagtcgatacccgtgcgctggaagaggtcggtctgaccgaagcccaggcacaggagatgtatcgttatctggctattgccaactacgaagatcgctttgtggtgccgagcagtcatcgtgaactggcgcgggaagccttcccggagaaaaatggctgcggctttacctttggtgatggctgccacggttcagataccaaattcaatctgttcaacagccgccgtatcgatgccatcgatgtaaccagcaaaacggagccgcacccatgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctatttgaacatgttcacggtgaatcccgtgaccgcggccaggcgatggtggatctgctggcgcagtacgagcagcacggcttgcagttaaacagccgcgaattgcccgaccatctgccgctgtatctggagtacctggcgcagctgccgcaaagcgaagccgtggagggtttgaaagatattgcgccgattctggcattgctgagcgcgcgtctgcaacagcgtgaaagccgttatgccgtgctgtttgatctgctgctgaaactggcgaataccgcaatcgacagcgacaaagtggcggaaaaaattgccgatgaagcgcgcgacgatacgccgcaggcgctggatgcagtctgggaagaagagcaggttaaattctttgctgacaaaggctgcggtgattcagcaatcactgctcatcagcgtcgctttgccggtgccgtcgcgccgcaatatctgaatatcaccaccggaggacagcactaatgcaattcctgaatatgttcttctttgatatctacccgtacatagccggggcggtcttcctgattggtagctggctgcgttatgactacgggcagtacacatggcgtgcggcgtccagccagatgctggatcgcaaagggatgaatctggcgtcgaacctgttccatatcggtattctggggatttttgtcggtcacttcttcggtatgctgacgccgcactggatgtatgaagcctggctgccgattgaagtgaaacagaaaatggcgatgtttgctggtggtgccagcggcgtactgtgtctgattggcggcgtgctgttgttgaaacgtcgtctgttcagcccacgcgtgcgtgcaacgactaccggagcggatatcttgatcctgtcgctgctcgttatccagtgcgcgctgggcctgctgaccattccgttctccgcccagcatatggacggtagcgagatgatgaaactggttggctgggcgcagtctgtagtgaccttccacggtggcgcttctcaacatcttgatggcgtggcgtttatcttccgtctgcacctggtgttggggatgacgttattcctgctgttcccgttctcgcgtctggtacacatctggagcgtcccggtggagtatctgacgcgtaagtatcagctggtgcgcgctcgtcactaagcgaattttagttcacatagaccctgcttcggcgctgagggatccccataaatcagcgataataaaccaacaccatattctggtaggttctggtgaggtgattaagaatggtgcttagcaccgttcgttttaaaattagcggggagtgtcgtaagacattctccgctaacctcagatacgagattacccgccgcgttttaatgctgttggcctgatatctaagatgtaacccttgattttcagcgtgatagccaataagccacagcactattgtgctcagtgttgccagcaggctcagtaccagcattcttcctgccgaacagctgtaactggctcgcagaccgaacccaaaacgctcacttttttcatccctggagttttgctcaatctgcattcggcggctgtataacttcatgatttctcgcggtttaaagtcatctgtgctgctgaatattaaccatggttcttttgccgccgacctggcatcttttatctgtgatggtctggctataccgcaacgcgaacgtttatttctccggcctttcggctcttttttgtgcaaataaaaatgaccatcgcaacgggcgtattccgcccgggaaagcgtccccggccccagatattcaggtttgttaccggcctgtaattcctgacgcctgaaccagcattccccttttctcgccagatgcagttgtttattgcctcgtatccggccaataaaatcccagccgagtgattttatgtgccgaaaccaggcattctggaaccctgcatccgtgacgatgattacccttgcttttgggtttaccgcttcggaaagagtattaagaaaggcttgctgtatctttgcattttgctgtttttccgaaggaactatccaactcagcaatggaatcgaatgtccatcgcaaatcaggctggcgcggagtacgtgatactcctgagaggggtatccactccagtcaacggcgatgacacacagtgacagcttgctcgtcagcatggaaataatgtttctgaaaatcagggggatgtcgtgatgaagagactcattaccgagcagacgatcaacacgttttattttatttttgacctgagcattaccgggtaaataacgtccgatgctggtcagcgtcagagatgcgccattgattagtgcgatagtggcatccaacaaagcattttgtcggtatttgtgaaatggtgctaaagcaccgcggaaaaaattctgacatacttggcgagcaggcatagaggagatctcattgaattggttgcacaagtcagtagatcacaaaactctatgcctgtctttttttacccgcccattactggggattcctcagcgctccggcgggttttttttatgggcacggtgcggggggagttgtcggatgcgcttcgcttatccgacctacaggggaggatattttaggtccggtaaacgcggtgccattgggcagaattagctcggagtaacaggttttgagtatttcaggaagaaatggtggtgggggaaggattactcagcgctgcgcgcttcgccctacgggtcgttgcctgcggcaacgctctctcgctggcactcgagtcgaaccttggtcgaagcctctcatccttccccgcatgggcagaatatttaattgcggattcgtttgagaattcaggggcttttgaaagtgatggtggtgggggaaggattcgaaccttcgaagtcgatgacggcagatttacagtctgctccctttggccgctcgggaaccccaccaagggtaattcatattgtaggtaatgcttgagatggtggtgggggaaggattcgaaccttcgaagtcgatgacggcagatttacagtctgctccctttggccgctcgggaaccccaccacggggtaatgctttttactggcctgctcccttatcgggaagcggggcgcatcatatcaaatgacgcgccgctgtaaagtgttacgttgagaaaaatgaactggttgcgtaattttcatccgtaacggattaaagctaaccagttatttttgctggcgattaaagaataatcgtccgattaccgtaaacaaagacgcgctgcgccagtactttgtatagcgcacgacttaagacgtttttctcgacgtcacgacctgcgcgcatcatatcttcagctgtgtaggtatgatcgacatgaataacgtcctgcatgatgattgggccttcgtccagattgtcattcacatagtgagcggttgcgccaataatcttcactccacgctcataggcctggtgataaggacgtgcgccgataaacgctggcaggaatgaatggtgaatattgatgatcttattcgggaagcgtgccacaaattccggcgttaatacccgcatatacttcgccagcaccacatagtcaggttgataagcatcaatggcatccgccatcttttgatcgtgctcgttgcggcttaacccttcatggcttaccagctcaaacggaatatcaaaccgctcaaccagagaacgtaaagtatcgtggttaccaataactgccgcgatttcgacatccaggccaccgtaattggctttcatcaacaaatcgccaaggcaatgcgcttctttagtgaccagaattactatccggcgacgaccggcaggattcagctcacgcacggagccttctggcaatgcgctatcgagatccgccagcagggtggaatcattaaaaatcccttccagttccgtgcgcataaaaaagcgcccggtacgatgatctacaaattcattgttctgcacgatatttaactcgtgcttgtagcaaatattggtaatacgtgcgatcagacctttttggtccggacaaatagtacgcagaactttacgttggagtgaatgcattgctggaaaaaccttgttgagagtgtttgctaaaccgtaccgtcaaccattattggccgcagcactttttaaattttttacctgaaccacaagggcagggatcgttgcggccaaactgcggacgtgtaccgtcaatatagtaccattgaccgttttctttcaaaaatcgcgaacgttcaattattgcacctgttttgccaccctcggtaaatcgagcaacaaaactgacaaatccgatattgccgccgtcctgccagcaatgttcaaatacggtcaatcccaaccattcagtatgcgcaaatccggcaatcaattcggcacgtaacgccgttgctccacaagatggatgccaggtctttattaaataatctgcgtcttgcatcacaaaagcgcagtaacgcgaacgcatgagatgttctggatcaggtgcaaccttttcaccagacacataagggtggcaacataggctatactcgacagcactaccacagggacaaagctgagacacaaataatctccctggaaacaataacggcgtattaaccgcctgagtagcactatgttaaccgagcagtagcgatgtggctacgattgcattccaggggaatcttgcgggaataatgagaaagataaaaatagggctggcgctgggatctggcgcggcaagaggttggtcgcatattggcgtaattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaatatcgcgaaataatgccggaaacagagatcgaaaattgttcccgtcgcttcgcggctgttgccaccaatttaagtactgggcgtgaattatggtttactgaaggcgatctccatcttgctattcgtgcatcatgcagtattccaggactaatggcacccgttgcgcataacggctactggctggttgatggcgctgtagttaacccaattcctatttccctcacgcgtgcattgggggctgatattgtgatagcggtcgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgccttaaaaggaaccgcatggcaggtgatccgcccgatattctgattcaacctgtttgcccgcaaatatctacgcttgatttccatcgcgcgcacgctgccattgcggccgggcagctggcagtggaaaagaaaatggacgaacttttgccgttggtacgcaccaacatttgaccagaatttttatctacacttaagttaattctgacaggcgcaggtggcaatagcatgccactattgagtaaagccagtcaggggagagaacatgacgcagccattggtcggaaaacagattctcattgttgaagatgagcaggtatttcgctcgcttctggattcgtggttttcctcattgggagcgacaacggtactggcggctgatggggttgatgcccttgagttgctgggaggtttcactccagacctgatgatatgtgatatcgcgatgccacgaatgaacgggcttaaactgctggaacatatacgcaacagaggtgaccagacaccggttctggtgatatctgccactgaaaatatggcagatattgccaaagcgttacgtctgggcgttgaagatgttttgctgaaaccagttaaagatctgaatcgcttgcgcgagatggtttttgcctgtctctatcccagcatgtttaattcccgcgttgaggaagaggagaggctttttcgcgactgggatgcaatggttgataaccctgccgcagcggcaaaattattacaggaattgcaaccgccggttcagcaggtgatttcccattgccgggttaattatcgtcaattggttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacatcaaaatcaacggttgccagagttgggcgcgttattgaagcaggtaaaccatttactccgtcaggccaatctgccggggcagtttccgctattagttggctattatcatcgcgaactgaaaaatctcattctggtttctgcgggtctgaatgcgacgttaaataccggcgaacatcaggtgcaaatcagtaatggtgttccgttaggcactttaggtaacgcttatttgaatcaattgagccagcgatgcgatgcctggcaatgccaaatatggggaaccggtggtcggctgcgcttgatgttgtctgcagaatgagcaaacgataacacgggctaaatttgcattacctgctaatgtcggctggtggtactatcgtcgctattcgtataagtaattgtcttaattatgctaactcgcctccttttcagaacttagccccttcggggtgctgatatactgggatgcgatacagaaatatgaacacgttcaaaacacgaacagtccaggagaatttaaatggctgccattaatacgaaagtcaaaaaagccgttatccccgtagcgggattaggaaccaggatgttgccggcgacgaaagccatcccgaaagagatgctgccacttgtcgataagccattaattcaatacgtcgtgaatgaatgtattgcggctggcattactgaaattgtgctggttactcactcatctaaaaactctattgaaaaccactttgataccagttttgaactggaagcaatgctggaaaaacgtgtaaaacgtcaactgcttgatgaagtgcagtctatttgtccgccacacgtgactattatgcaagttcgtcaggggctggcgaaaggcctgggacacgcggtattgtgtgctcacccggtagtgggtgatgaaccggtagctgttattttgcctgacgttattctggatgaatatgaatccgatttatcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggcgtggttgaaaaaccaaaagcggatgttgcgccgtctaatctcgctattgtgggtcgttacgtacttagcgcggatatttggccgttgctggcaaaaacccctcctggagctggtgatgaaattcagctcactgacgcaattgatatgctgatcgaaaaagaaacggttgaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaacatccgtatcggtgttttccacgaaacggcgttgagcaatcgacgccgtttttttatagcttattcttattatattgtcttaaaccggacaataaaaaatcccgccgatggcgggatttttagcatgtgcaatctacaaaagattattgcttgatcaggaaatcgtcgagggatttaccttgctcatccattgcttttttgattacagctggagtacggccctggccagtccaggttttagtttcgccgttttcgtcaacgtagctatattttgccggacgctgagcacgcttagctttggtgccagatttaacggcagcaaggctattcagcagttcgttcgggtcaataccgtcagcgatcagcatttcgcgatattgctgcagtttacgagtgcgctcttcaacttcagcagcagccgcgctttcttcttcgcgacgttcgttaacaacaacttctaatttttccagcatttcttccagcgtttcaagtgtacattctcttgcctgcgcacgaagagtacggatgttgttcagaattttaagtgcttcgctcattgtagtaatctcaaacttatattggggtggtttgttgaggtaataatagagccttaaattcagttgtgcaatagccaggaatgtaaggaattcaaaattgttctttattttgtgccgccaataaatatcttttcataaaattagccagaaaagacgcggcatatagccctatttgcaccgatgatttcgcagcacgtgaggttaaaacttcctgattcatgtcacattttatggggagataatcgtaggctgacgacctttcagtcttctgtattagccgtgtttacgagaattccctattaagcgaatgatgaaaagtagaacagtcgcaataagagcagggacttagtattgcactatctcctggaggtcaacagagggctattacatgcgcaacaggttaaagattgtgaatagttaccggcagtcatttacccgcttataacaagcgaggcagttgtaatgatagctcagaaggattatgcaaggcttcgtaagggagaacgcatataccacttctgtgcatactgttgagctgaaaaactgacgaattatgataaactccagccaactttatttcatatcattgagggcctgtggctgatggcacagctatatttctactattccgcaatgaatgcgggtaagtctacagcattgttgcaatcttcatacaattaccaggaacgcggcatgcgcactgtcgtatatacggcagaaattgatgatcgttttggtgccgggaaagtcagttcgcgtataggtttgtcatcgcctgcaaaattatttaaccaaaattcatcattatttgatgagattcgtgcggaacatgaacagcaggcaattcattgcgtactggttgatgaatgccagtttttaaccagacaacaagtatatgaattatcggaggttgtcgatcaactcgatatacctgtactttgttatggtttacgtaccgattttcgaggtgaattatttattggcagtcaatacttactggcgtggtccgacaaactggttgaattaaaaaccatctgtttttgtggccgtaaagcaagcatggtgctgcgtcttgatcaagcaggcagaccttataacgaaggtgagcaggtggttattggtggtaatgaacgctacgtttctgtatgccgtaaacactataaagaagcgttagaagtcggctcattaacggctattcaggaaaggcatcgccacgattaataagaatttctttactgacagggtgagcagggcgcttttatcctgtcagttcgttttacgcacttctttcgggctatacacccttctcggcagttttttaacgccgctatacgcctcacagagcgcttatacaccgacattgacttgtaacctgtaaagtacaatatcgctgtgtgtaggcgttatacatcgtcgcaaatatgatgaaggacaatgctgccggtttatggaaaagttgttttgggaaaacaaaaaacggccccagaaggggtaatgccagtcagttaagcaactgactggctctttttcggggctgtggggtatttccagggcctctcctttaccactctcgggaaggccctttcccttcttgtcggtaatttcactggttgtcccatacttgcaagatcgcgcatcagctccggtatacgtcctggggaagcgtatggcgtccgtcatcgacgtcagcagatggcagacttttcctttgcgcgtcacggtcagcaggcgggctgtcacctcatttcccagtcccggccacttttttcgtgcctgcgggctggttttcagcttcaccagatgatcgcctttacccagttttctaatctcttcatattgcgctccctttctgagagggatcatccagtggcggtgttctcccgccaggctccaggcatttaacagtcctggtgagtaataacctttatccattaacgtcagagtgttatcgccggtttgttctataagttgctcagcaagctcattttcgctgttcttcatcgtgccgaaggctgcagccgtcagcagatggctggtcagttccatctggcagaccattttgacctgcgggtagagcgccgagttcccggcatgtgtctggcgggggaaggctgcatcgttctctggtgtatccggtgtgcgccagaacacaccatcgatggccagcagggtcaggccgcaccagtgcggatgcggcgtggcgttatgccagagctgcgctgttttcgtgaacacgcggcggacagcctcaattcccagacgctggcgggtctgaataacggcactgggggcaacgaaggggcgattgcccggcagcatgatgtccaggcgattcacaatctggtgaagaggttctttacgctcaagcgccatgccaacaatacaccagaccgtcatttcgaggggaagacggcgcttgcgtagcgttacagtacctgattcggcaaggcaacgagagatgagttcggggtcgaggtaatcccccagagaagtcagtgggttacgcagagaatcgtaacgggataccaaatcaagggcctgcccaatgagcataaaaaaatccggaaacgagtgagcgtttccggattcttacacagccactggatcggtcaactgatccttaactgactggcattaccccagaaggggccgtttatgttgccagacagcgctactgattaagcggattttttcgcttttttctcagctttagccggagcagcttctttcttcgctgcagtttcgccttctacataatcacgaccgtagtaggtatccagcagaatctgtttcagctcggagatcagcgggtaacgcgggttagcgccggtgcactggtcatcgaatgcatcttcagacagtttatccacgttcgccaggaagtctgcttcctgaacgccagcttcacggatagatttcggaatacccagttcagctttcagcgtttccagccatgccagcagtttctcgatcttagctgcagtacggtcgcccggtgcgctcagacccaggtggtcagcaatttcagcataacgacggcgagcctgcggacggtcatactggctgaatgcagtctgcttggtcgggttgtcattcgcgttgtagcgaataacgttacaaatcagcagggcgtttgccagaccgtgcggaatatggaactgggaacccagtttgtgcgccattgagtgacatacacccaggaaggcgttcgcaaacgcgatacccgcgatagtcgctgcactgtgaacacgttcacgcgctaccggatttttagacccttcgtggtaggacgctggcagatattctttcagcagtttcagtgcctgcagagcctgaccatcagagaactcagatgccagtacagaaacataagcttccatggcgtgagttactgcgtccagaccaccgaaagcacacagggacttcggcatgtccataacaaggttggcgtcgacaatcgccatatccggggtcagtgcatagtctgccagcggatatttctgaccagtagtgtcgtcagttacaaccgcaaacggagtgacttcagaacctgtaccagaagtggtggtgacagcgatcattttcgctttcacacccattttcgggaacttgtagatacgtttacggatatccataaagcgcagcgccagttcttcgaagtgagtttccggatgttcgtacataacccacatgatcttcgcagcgtccatcggggaaccaccacccagcgcgataatcacgtctggtttgaaggagtttgccagttctgcacctttacgaacgatgctcagggtcgggtcagcttctacttcgaagaagacttcagtttcaacgcctgctgctttcaatacggaagtgatctgatcagcataaccattgttgaacaggaagcggtcagtcacgatgagcgcacgtttgtggccatcagtaatcacttcatccagcgcgattggcagggagccacggcggaagtagatagatttcggaagtttgtgccacaacatgttttcagctcgcttagcaacggttttcttgttgatcaggtgtttcggaccaacgttttcagagatggagttaccaccccaggaaccacaacccagagtcagggaaggtgcgagtttgaagttatacaggtcaccgataccaccctgagaagccggggtgttaatcaggatacgagccgttttcattttctgaccgaagtaagaaacgcgagccggttggttatcttggtcagtgtacaggcaagaggtgtgaccgataccgcccatagcaaccagtttctctgctttttctaccgcgtcttcgaaatctttagcacggtacattgccagagtcggggacagtttttcatgtgcgaacggttcgctttcatcaacaacggtcacttcaccgatcagaatcttggtgttttctggtacagagaagcctgccagttcagcaattttataggctggctgaccaacgatagccgcgttcagcgcaccgtttttcaggataacgtcctgaacagctttcagctctttaccctgcaacagatagccgccgtgggttgcgaaacgttcacgtactgcgtcataaacagagtcaacaacaacaacagactgttcagaagcacagattacaccgttgtcgaaggttttggacatcagtacagatgcaactgcacgtttgatatcagcagtttcatcgataacaaccggagtgttgcccgcgcctacgccgatagctggtttaccggagctgtatgcggctttaaccatgcccggaccaccagtcgcgaggatcaggttgatgtctgggtggtgcatcagtgcgttagacagctcaacagaaggttgatcgatccagccgatcagatctttcggagcaccggcagcgatagcagcctgtagaacgatatcagccgctttgttggtggcatcttttgcacgcgggtgcggggagaagataatggcgttacgggtcttcaggctgatcagcgatttgaagatagcagttgaagtcgggttagtggtcggaacgataccgcaaataataccgatgggttcagcgatagtgatggtaccaaaagtgtcgtcttcagacagaacaccacaggttttttcatctttataagcgttgtagatatattcagaagcaaagtggtttttgatcactttatcttcgacgatacccatgccggattcggcaacggccattttcgcgagtgggattcgagcatctgcagcagccagagcggcggcgcggaagattttgtctacttgctcttgagtgaaactggcatattcacgctgggctttttttacacgctctacgagtgcgttaagttcagcgacattagtaacagccataatgctctcctgataatgttaaacttttttagtaaatcatctgctcgaatacgagagtatagtcagtgcggtgatgatttgcttaaccgatggaaatcaaaagcttactcgcgctcacactcactgtgatttactaaaagagtttaaacattagagttattatctctaatgcgtcacttccaggtggcgtaagcaagattactcacttctgggtactgattacgtgatccaaatcaaaattttgcaaagctgacacctttcagcatggcttttcgccattatagctaacagttaataaattgtagtatgatttgttggctacattagcatgttttgcacaactagataacaataacgaatgatagcaattttaagtagttaggaggtgaaaaatgctgtcaaaaggcgtattgtcagcgcgtcttttcaaccttatttatggctaacattatccggcttttgcttcggagctaaccgtgattcagaccctttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctgcaactttttggtatatcaattgattcgttccgtatcgccgggggcatcctggtggtgacgatagcgatgtcgatgatcagcggcaagcttggcgaggataaacagaacaagcaagaaaaatcagaaaccgcggtacgtgaaagcattggtgtggtgccactggcgttgccgttgatggcggggccaggggcgatcagttctaccatcgtctggggtacgcgttatcacagcattagctatctgtttggtttctttgtggctattgcattgttcgctttatgttgctggggattgttccgcatggcaccgtggctggtacgggttttacgccaaaccggcatcaacgtgatcacgcgtattatggggctattgctgatggcattggggattgaatttatcgttactggtattaaggggattttccccggcctgcttaattaattcctttcaaatgaaacggagctgtcatgctccgtttacttcgtcattatttttactttgttcccgcgcagttatcaaaagcaaaaggaatgggtgaaaatattcttctcaaattacagttggttataaggatttccttaactgcttctcctcaccatcatgttattttcgccacatcataatcctgggcttgctgaagaataattgaaatgatattagtaattccactgcctttggtagaggaaagtgctaaataataatcaattgttaaattattgtgcatttcactactggaactgtaatcagaaaagagagacatgcttaaccaatctctatttaattgaattaaaagatgtttgttaagacatggatgcaagctatagattctgatacggtcaataaaagagaattgcttaacaattttgcaaaatgtattggcgagtaagaaccgcatttggtactttccgggcaaccgccagacgattctttattggtaatgagaataattaacaattaaagagcgtcgcgaaagaataatgtgtctcgacaggggagacacagtacgaatcgacataaggtgatcgtctgaatcaccagaataaataaagtcggtgatagtaatacgtaacgataaagtaacctgacagcagaaagtctccgagcctgtgcagggtcccaatccgggattacacatgctggttaataccagtaattataatgagggagtccaaaaaacaatgaccaacatcaccaagagaagtttagtagcaactggcgttctggctgcgcttatggcagggaatgtcgcgctggcagctgatgtacccgcaggcgtcacactggcggaaaaacaaacgctggtacgtaacaatggttcagaagttcagtcattagatccgcacaaaattgaaggtgttccggagtctaatatcagccgagacctgtttgaaggcttactggtcagcgatcttgacggccatccggcacctggcgtcgctgaatcctgggataataaagacgcgaaagtctggaccttccatttgcgtaaagatgcgaaatggtctgatggcacgccagtcacagcccaagactttgtgtatagctggcaacgttctgttgatccgaacaccgcttctccgtatgccagttatctgcaatatgggcatatcgccggtattgatgaaattcttgaagggaaaaaaccgattaccgatctcggcgtgaaagctattgatgatcacacattagaagtcaccttaagtgaacctgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttacctattgcttctgaagttaccgatgtcaaccgctaccgtagtggtgaaatcgacatgacttataacaacatgccgatcgaattgttccagaagctgaaaaaagagatcccggacgaagttcacgttgatccatacctgtgcacttactattacgaaattaacaaccagaaaccgccatttaatgacgtgcgtgtgcgtaccgcactgaaattgggtatggaccgcgatatcattgttaataaagtgaaagcgcagggcgacatgcccgcctatggttacactccaccatatactgatggcgcaaaattgactcagccggaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggcacttttgatgtggcccgtgcaggctggtgtgcagactacaacgaaccaacttccttcctgaacaccatgctgtcgaacagctcaatgaataccgcgcattataagagcccggcctttgacagcattatggcggaaacgctgaaagtgactgacgaggcgcagcgtacagctctgtacactaaagcagaacaacagctggataaggattcggccattgttcctgtttattactacgtgaatgcgcgtttggtgaaaccgtgggttggtggctataccggcaaagatccgctggataatacctacacccggaatatgtacattgtgaagcactaatggcaatacgtggggcaggagtgtcctgctccacggtgtctgatttttatcgcattacagaaggcacaggccagaaggtagggcaatgttaaaatttattctacgtcgctgtctggaagcgattccgacgctatttattcttattactatttcgttctttatgatgcgcctcgctccgggcagtccttttaccggcgaacgtactttaccaccggaagtgatggccaatatcgaagcgaaatatcatcttaatgatccgatcatgactcagtatttcagctacctgaaacaactggcgcatggcgatttcggtccatcgtttaaatataaagattattcggtcaatgacctggttgcatccagttttcccgtttctgccaaactgggagccgcagcattttttcttgcggtaatactgggtgttagtgctggcgttattgccgcattaaagcaaaacaccaaatgggactataccgtgatggggctggcaatgaccggggttgttatccccagttttgtggttgcgccattattagtcatgatatttgcgatcattttgcattggctgccgggcggtggctggaatggtggagcgcttaaattcatgatattgccaatggtggcgttatcactcgcctatatcgccagtattgcgcgtattacccgtggctctatgattgaggttttacactccaactttattcgtactgcccgggcgaaagggttacctatgcggcggatcattttacgccacgcattaaaacctgctctgttacccgtgctctcctatatggggcccgcatttgtcggcattattaccggttcgatggtcatcgaaaccatttatggtttaccggggattgggcaattgttcgttaatggcgcattgaaccgtgactattccttagtgttaagtctgaccattctggttggcgcgttaaccattttgtttaatgccattgtcgatgtgctatatgcggttatcgacccgaaaatccgttactgatactggagctcgcgatgatgttaagtaagaaaaacagcgagacgctggaaaatttcagtgaaaagctggaggtcgaagggcgcagcttgtggcaggacgcacgtcgacgttttatgcataaccgtgcggcggttgccagtctggtagtgctggtgctgatcgcgttatttgtaatcctggcaccgatgctttcgcagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggcagtggtcgtggggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgattggcatggtttcctggctggatatggctcgtattgtgcgtgggcaaaccctgagtctgaagcgcaaagagtttattgaggcggcacaagttggcggtgtatcgacgccgggcattgttattcgccacattgtgccgaacgtactcggtgtggtggtggtctatgcgtcgcttctggtgcccagcatgatcctctttgaatctttccttagcttcctgggattaggtacgcaagagccgttaagcagctggggtgcattgctgagtgatggcgcgaactcgatggaagtctctccatggttactgttgttcccagcgggattcctcgtggtaacgctgttttgtttcaactttatcggcgatggcttgcgtgatgccctcgacccgaaagatcgttaaggagtgcagccatgagcgtaattgaaactgcaactgtgccgctcgcacaacaacaggctgacgcactgctgaacgtgaaagatttgcgtgtcacctttagtaccccggatggcgacgtcacggcggtcaatgatttgaatttttcgctacgtgccggagaaacgctgggcatcgtaggtgagtctggttcgggcaaatcgcaaaccgcatttgcgttgatgggcctgttggctgccaacggacgtattggcggatcggcaaccttcaatgggcgtgaaatcctcaatttgccagagcgtgaactcaataaactgcgagctgaacaaatctcaatgatttttcaggacccaatgacttcgttgaatccctatatgcgcgtcggtgagcagttgatggaagtgctgatgctgcataagaacatgagcaaagctgaggcgtttgaagaatcggtgcggatgctcgatgcggtaaaaatgccggaagcgcgtaaacgcatgaaaatgtacccgcacgaattttctggcggcatgcgtcagcgagtcatgattgcgatggcattgctatgtcgacctaagctgctgattgcggatgaacccactactgcgctggacgtcaccgtacaggcgcagatcatgacgctattgaatgaactgaagcgggaatttaataccgccatcattatgattacccacgatcttggcgtggtggcggggatctgcgacaaagtgctggtaatgtacgctgggcgcacgatggaatatggcaacgcgcgcgatgtcttttatcaacccgtacatccttattctatcggtttgctcaacgcggtgccgcgtctcgatgcggaaggtgaaacaatgttgactattccgggtaatccgccaaacctgctgcgattaccgaaaggttgcccgttccagccacgttgtccgcatgcgatggaaatttgtagtagtgcaccgccgctggaagagtttacgcctggccgtctgcgtgcttgctttaaaccagtggaggaactgttatgaatgctgtaaccgaaggaagaaaagtcctcctcgaaatcgccgatctgaaagtgcactttgaaatcaaagatggcaaacagtggttctggcaaccgccgaaaacgctcaaagccgtcgatggtgtaactcttcgcctgtatgaaggggaaacattaggtgttgtaggggaatcgggatgcgggaagtccacctttgctcgcgccatcattggcctggttaaagcgaccgacggtcatgtggcctggttaggtaaagagttgctgggcatgaagcccgatgaatggcgtgccgtacgcagtgatattcagatgattttccaggatccgttggcatcactgaacccgcgtatgaccatcggcgagatcatcgctgaaccactgcgtacttatcatccgaaaatgtcacgccaggaagttcgcgagcgcgtgaaggcgatgatgctgaaagtcggtttgttgcctaacctgattaaccgctatccgcatgagttctccggtgggcagtgccagcgtatcgggattgctcgtgctcttattcttgaaccgaagctgattatctgtgatgagccggtgtcggcgctggacgtgtcaattcaggcgcaggtggtcaacctgctccagcagttgcaacgtgagatgggattgtcattaatttttatcgctcacgacctggccgtggtaaaacacatttccgatcgtgtgctggtgatgtatctcggccatgcggtagaactggggacctatgatgaggtctaccacaatccgctacatccttacaccagggcattgatgtcggcagtccccatacctgatccggatctggagaagaacaaaaccatccagttactggaaggggaattaccgtcgccgatcaacccgccttccggttgtgttttccgtacccgttgtccgattgccggtccggagtgcgccaaaacacgtcctgtgctggaagggagtttcagacacgccgtttcttgcctgaaagtcgatccgctttaaaagcaataagggctgacagttgtcagcccttttcacgccaaaagcgattatttattcccgccagatgatatggcaaagtttgtgatctttttcgcggcataacagaatgcgcgcgaaaacatcgttgatttcaccatcttcactgtccgccagaccaatcaccacttcggcaaaaaagtccgggttcaaatcgaaatcaacatgttcctgccagtcttccgccggatcgaataactccgcgccgccgcgctcttcaaactgaagattgaacagcagaacatcagctggatcgagattgtcggcagccagttcgagaaaaatatcgtaggcctgctcaagcgtttcatcttcagtcaggcgattgtttagatccatatccatagtcactacctgtttaacctctgttggcgacgttttacagcaacgggctgaagaagtaaaacagtcgctcggcgacacgttgccataatggacgttttagccataaacgggcatcgagcagacgagaacgcgaaatataatcgtcctgaacggcggcgaggtctgcaccaaaacctttatcgtcgattgccagggtaatctcgaaatttagccacagactacgcatatcaaggttaacggtgccaaccagacttagttcaccatcgaccagcacgctcttggtatgcagtaacccgccttcaaactgataaattttaaccccagcagccagcagttctgtaaagaatgcgcgactggcccagccgaccagcatcgagtcattttttcgcggaaggataatactgacatccaccccgcgctgcgccgccgtgcaaatcgcatgaagtaaatcatcgcttggcacaaaatagggcgttgtcatgatcaaatattcacgagccgaataagcagcagtcaataatgcctggtgaatgagatcttccggaaagccggggccagaagcaattgtgtgaatagtgtgaccgctggcctgctcaaacggcataatattgacatctggtggcggcggcagaatacgtttcccggtttcaatatcccagtcgcaggaataaataatccccatcgcggtggcgatggggccttccatacgcgccatcagatcaatccattgccctacgcccgcatcttgtttgaagtagcgagggtcgaccatattcatgctgccggtgtacgcgatgtaattatcaatcatgatcatcttgcgatgttggcgcaggtccatacggcgtaaaaacacacgcatcagattgacctttaaggcttcgacaacttcaataccggcattacgcattagctcgggccacgggctgcggaaaaaagccacactcccggcggagtcgagcatcaatcggcaatgaataccgcgccgtgcagcggccattaatgattcagccacctggtccgccatgccgccgggctgccagatataaaacaccatctcaatattatggcgcgcgagctggatgtcgcggattaacgcctgcatcacatcatctgactcggtcatcagttgtagctgattccctttgaccccagcgatcccctgacgacgctcgcaaagcttgaataatggcgcagcgacactgctattttcttcggcgaagatatgcttacaggctttaaggtcgttaagccattttgcggtggaaggccacatcgctctggcgcgctcagcgcggcgtttgcctaaatggagctcgccaacggcaagataggcaataattccgactaacggcagaatgtaaataatcaacagccaggccatcgcggagggaactgcgcgtcgtttcattagaatgcgtaaagttacgcctgcaatgagcaaccagtatcccagaatggccaaccaactcaccaacgtataaacggttgtcatagattagaaatccttttgaaagcgcattgttatgagtttacgcatatggattcatctggcaaataaaaacgcgggaaaagcactggtcagcgtcaggggcgggggtataatgaccattctgttgttgcatagagtagttaacatgaagcggagtagaacggaagtggggcgctggcgcatgcagcgtcaggctagccgacgtaaatcgcgttggcttgaggggcagtcgcgccgaaatatgcgtatccacagcatcaggaagtgcattctaaacaaacagcgtaactcgttattgtttgcgatctacaatatctaaatgtactgggcaccattgcggtgcccaataagtttactcttccgtctttaaactctatttttgcgccgattctttactgtcagctttcgtttcttgttcatcgttatcgctgaaaatgccatgaccggagttcaacaacattgaaacgagcatatcattattaatctcttcaccatttaaaactcgcgccagaatttcgctgccaaacagttgtggtgagagaatgatatccggatgtaccatcttaatcttattcaggtttttgctatcactgacggcgagaactgttttgacatcactgctcatatcttttgccgagagtacaacaaacgcgttatctgcatcgttatcactcagcgccagaatggcccggcaacgatcgattcccgctttctttaacactgaactgtcattactgtcaccggggataacatcggcgttatcgcctaagcgttgctcaagttgcttgatatcatcttcaggcaagttgctgataaccgttacgttttgtccgcgttgattcagttgcagaatcgtattgatggcgagaatcgaatgtccgcaaacaataaaatgatctttacgatgcattgtatgattgtttccttttacaagtttgttgaatcccccgcggataagcggaccaaaaattgaggtcatagatgtggcaaaaacggtaatgccggaaataatgaccgaaatagtgaacaatcgtgctgattcagaaacagggacaatatcgccatagccgacggttgacatggtttctatcgaaaaatagaacgcggtcatcaaactttctattcgcggattaaaaccttcgcttaaataaagcgcaccgtaagtggagtaaaacagtaacgtcgtgaaactaataaatgcgaaaattgtcccggctgctgcgctactgtgggagaagtctttgcgcagtatcagcaaaaacaccagcgtaaaaatgcaaaatccaatactaaatttcagccagggataaaaatgcagagtgtaaattagcgctatcaacaacaaaatgatactgattgcccatgcgagctttgcccggaacagtaagccaatggagttcaggacaagaaatacgccgagcataaatagtggggcgtttgccagcaaggagagatccagctctgaaaatgctttgatatggaaaatatcaagcaaattgaccgacataccatagattgttttaaaaataagcaatccatttaaaaagacggccagcgcgagaatgtcgtgccgtagggtcacccataactttgttgctgtttgtttgaatgtagtccagtgactcactgatacctctgtaaccacaattttgtttaattatctcaacgtgcacattttcttaacatacatgcagcgcgtgaatgtgttaaacaatagtagatgactttatccgcagtaatcaaaggttttgagtgagcaactctgcgtcaggaaagggcattttccagaatatgttcacatcatataaagaaatacagataaagttattatctgcttgtggtggtgaatgcactgaccgacctataaggaaaggccaaacaagaacacggttgcaaaaaccgtgcccttaaatattgaatttctattcagaacactttcttaaatggtttcactgaaacgtgttcatagactcctgccgctacgtacgggtcagcatcggcccaggcctgagctgcttccagcgactcaaattcagcaataacggttgagccagtaaatcccgcagtccctggatcgttactgtctaccgctggcattggaccggcggtcaacaaacgaccttcatcatgcagtaactgtaaacgtgctaaatgtgccggacgaacggaaaggcgtttttcgaggctatcagctttgtcttgagcgtaaataacatacaacacgggcacaactccttgttcgggaaagttgtaaagtacgttatttgaaagggcgaagatctgcaacggaaagatgatgtctttgttaagaccatgcataaagtaaggtcaattacgccaaaaatgacattttcactgatcctgatcgtcttgccttattgaatatgattgctatttgcatttaaaatcggggcctggtttttctactgaaatgattatgacttcaatgacccttgatttacctcgccgcttcccctggccgacgttactttcggtctgcattcatggtgctgttgtggcgggtttgctctatacctcggtacatcaggttattgaactacctgcgcccgcgcagccgatttctgtcacgatggttgcgcctgctgatcttgaaccgccacaagccgttcagccaccaccggagccggtggtagagccagaaccggaacctgagccgatccctgaaccgccaaaagaagctccggtggtcattgaaaagccgaagccgaaacctaagccaaaaccgaagccggtgaaaaaggtggagcagccaaaacgcgatgtcaaacccgtagagtcgcgtccggcatcaccgtttgaaaatacggcacccgcgcgcccgacatcaagtacggcaacggctgcaaccagcaagccggttaccagtgtggcttcaggaccacgcgcattaagccgtaatcagccgcagtatccggcacgagcacaggcattgcgcattgaagggcaggttaaagttaaatttgatgtcacgccagatggtcgcgtggataacgtacaaatcctctcagccaagcctgcaaacatgtttgagcgtgaggtgaaaaatgcgatgcgcagatggcgttatgagccgggtaagccaggcagtgggattgtggtgaatatcctgtttaaaattaacggcactaccgaaattcagtaagcataaagtcaaaagcctccgaccggaggcttttgattattactcaacgggtaaggcgcgaggttttccttcgggatcaaccgcgacatacttaaataatgcttctgttgctttatagcgttgcccgattggttcagacgccacttttttcacccacacttcaatattaatgctgactgatgtcgtccctttctggacacagcgtgcatagcagcacaccacatcgccgaccgcaaccggccgtaagaaagtcattccttcaacccgcacggtcactacacgaccatgggcaatttctttcgccagaatagcgccgccaatatccatttgtgacattaaccaaccaccaaagatgtcaccattggcattggtatcggcgggcatggctaaagtacgtaaaacaagatcgccctgagggacgttatgtgttgtagacatggtaaaaccgacttaaaaggaaaatcacaggcgcgatgctactatgattttcctgaggagaacagaggagatacagcgccagcccctgaaggactggcagtctggttaggatttatcttcctgcggcatgtggcggtagatatagataccgcttaacaatgtgaagattaaggtaagggcggtcaggccaaagactttaaagttgacccaaatattttgcggcagccagaatgcgatgtagatgtttgccagaccgcaaaggataaagaaaacagcccaggccagattcagcttcgaccataccgattgcggcagggtgagttctttacccagcatccgctgaattagcggctttttcatcacccattggctgactaacagggcacccgcaaacagggcataaatgacagtaaccttccatttaataaactcatcattgtggaagaacagcgttaagccaccgaagacgaccaccagaacaaaagtgatcagggccatcttctcaaccttacgaaagcgaacccagctatatataagcacaatcgccgtggcgacgatgagcgccgcagtagccgcatagatgtcataaatcttgtaaaacgcgaaaaagacaaccagcggtaaaaaatcaagaaactgcttcattttacgattccgtaatcaaatgcttaaggttattggcgaatcaacatatacaggcggaacagatagatgagcaatacggctgaaatcaggttgctcaaggtgttcgccagtacggcaccaatttccggggttaatgcggcaaaagaagaggcaaaaagcagcaacagtgtttttgccagcaaccagctcagtactgcgggtgccaccagacgcatattcgcccatgtcagccgcatactgctacgcatcgaggcaaaaacgcccattttgtcctgtaccagcatcactggagccagagccagtaaaatggccatgataatccccggaacgaccaccagcatgatgccaatctgtactaaaagggtagtcagaaaaatcagaataaataactttggcaatatcggcgcactggcaccaatagctcgcagcgcactgactctctgacccgcagacaccagctggataattaatattacgcccccggcgagaatggcgttaccgattaatcctgaaaaagtggacgccgctgaagcctgcagcaaaatttgttgctgttccggtgacatattctgaaccaggtcgaacaacccactactgccgctaacgggtacgccgtcattgagctgcgcaagctgtgcatcactgggtgagaaaacatgccctaacaccactgtgataaacgcacatagcaacgataccaacagaatggtcataaattgattacggaagaaatttccggtgtcacggtatacggactgcgccgtgatagacatgcactctccttgagttttatgcaggtgttaattagcgggcaattgtaccctggttaagccccgggtggcagcatcaggtcttgtatggaaaagcatatctttgtaaagcggaggtaattgctggccttcaggcgtgggtaaaccgctgcaagtggcgagcgagttaatatttgcgtagcgaaaatataaaaattgatttaaatcacattaacctggattttaaatgcaacttctaaattaatccagatcaataaagggtgaattaccatatgtaatgtgatctgtgtaggatcatttgttaccccaatgtgggtatattcgtcacgtttttataaccataacgacggagcggatatgaaaaagttaacagtggcggctttggcagtagcaactcttctctctggcagtgcttttgcgcatgaagccggcgaattttttatgcgtgcaggttctgcaaccgtacgtccaacagaaggtgctggtggtacgttaggaagtttgggtggattcagcgtgaccaataacactcaactgggcctgacgtttacttatatggcgaccgacaacattggtgtggaattactggcagcaacgccgttccgccataaaatcggcacccgggcgaccggcgatattgcaaccgttcatcatctgccgccaacactgatggcgcagtggtattttggtgatgccagcagcaaattccgtccttacgttggtgcaggtattaactacaccaccttctttgataatggatttaacgatcatggcaaagaggcggggctttccgatctcagtctgaaagactcctggggagctgccgggcaggtgggggttgattatctgattaaccgtgactggttggttaacatgtcagtctggtacatggatattgatacgactgccaattataaactgggcggtgcacagcaacacgatagcgtacgcctcgatccgtgggtgtttatgttctcagcaggatatcgtttttaattccgcacaaaaatgaccccgtaattacggggtcaataaggacatggtataaagggtattatttcttcgcttctacgccatcagtttcagagcgaattaagaatttctcagttgtttgcggaatatgctgaattagccagtcggccatgtgcttttcatcatttaaaatcgcttcgataatcggaattgaggctgtatcaccggcattttttgctgctgctaagagtgaggtataacaggcgatttcaaattgctcgaagacatatccgctaatagagcctttgactatttcatcagaagggaatataccaccgattgactgcccaagtgcagccattttactcatggaatctttaatgactgaacgtgaaatgtcattacgatcaagaatagtttccagttgaacaatctggtttttggtttcactaagatgttgttcaatacgagcgcgtagttcaggataattatctatacgactggccatggattcaagcatagattcggcttgcttttccattgcgtgggcgtcacgtaaccagtcatgataatgttcaatacgattcatgaaaatgtcctctttataaaatgactaaaagttaaagttcatatttcaggctttattttcggctttcttatttacgttattaagggccagatcagtcaatttgatgtcggtggccttttcttcttccagggtatctttcagaagcttcgctgctttacgataacctaattgttcagccagcgtcgctaatgtcccgtaactggcaatctcataatgctcgactttctgtgctgcggcaatcagtgcggcatcacgcacttcgtttttctcggtactttcgatgacctcatcagcttcttcaataagaccttccattgccacacatttcatgcgcttaattttcagattcgattctgattccacaacttgatcaatacgttcaatctgcctatgtgtttcctcgaggtgcgcatgaaaatcctgacttaatttttcgtttgatgttgctcttgcgagttttgccagtgcccgggttaattgtttttctgcgctgtaggtatctgaaagcaggtgaataaatacatcttcaatggtcttcatattcatatttttctccagtgaaatcactgcgagccatacggcccgcagaggcaattatctttatcagctgatattaataattaacggtgaatcaggattttcctgatttattaccaccgctttgttgaccgccttttttacctgcttcggatgcgcgttgcggatcatttttaaaattaccgccgctatgctgaccgcctttacggcctgcgttggatgccttctcacggtcttcggcgaaatttcctgaaccaccacgatattcggtcatgttatttctcccgttgcgttgcattgtttcattaatatgagtgttgtgtgtcgacactcattaaaattagtcgttaatgagaattagtcaaattaagcgtaacgagaagaaagtggaaaaatatattttgaggaacgttctggatgtattaacaattgcctgaggaataagtgacttagagaaaattattgattttactggtgttatgttgcgggattaatttgtttgattatattactgttgggcggaaaaaagacgtaagttgacgttcgacaggggtaagcgaaacggtaaaaagataaataataaatgaatttaggatttttccggcttcgttaaagaaagttaaaatgccgccagcggaactggcggctgtgggattaactgcgcgtcgccgctttcatcggttgtacaaaagctttcagtgccgccagcattttctctggctcattaatatgttgctcgatgattttaacgatggccgaaccagaaatcgcgcccgcagctcctgcatcaatcgctgcttttacctgatccggggcggaaataccaaatccctgcaatggaggcgcagcgttgtactctttcagcttcgcaaccagatgattgaggggtaacgcggcgcggttttctgcgccggtcacgcccgctcgcgacagcaaataggtgtaaccacgaccgtaagaggctatctggcgcagcaaatcatcgtcggcattcggcgggcaaataaagataggtgcgacattatgacgcaacgcggcctggcggaagggcgcggactcttccacgggcacatcggcaaccagcaccgaatcgacgccgactttctcgcactcggcataaaactcatcaatgcctttgttaaacaccaggttggcatacatcaaaaggccgatgggaatggtcgggtgcttctggcgaatgagtgccagcacctcaaagcactgcgccggggttactcccgccgcaaaagcacgcagtgtggcgttttgaatcgtcgggccatccgccagtgggtcggagaagggggtgcctaattccagcgcgtcagcaccggcttcaattagcgtatcgataattttcaacgactgctcaatgcccggatcaccgagggtgacgaaaggaacgaatgcgccttctttgcgctccttcaactgggcaaacagagattcgtagcgttccatcagatttcccctcgtgctttcaaaatatcgtgaacggtgaagatgtctttatcgccgcgaccggaaaggttaaccaccagtagctgctctttttccggattttcgcgcatcattttcagcgcatgggccagggcgtgggaggattccagcgccgggatgatcccttcatgcaggcaaagcgttttaaaggcttccagggcttcatcgtcggtaatagacacgtaatcagcgcgtccagtgctgttgagatacgcatgttgcgggccgacggacgggaaatccagcccggcagaaatggagtaagactcttcaatttgcccgtcttcggtttgcatcatcggcgctttcataccgaaatagatgcccacgcgaccatgttttaacggtgcgccgtgctcgccagtttcgataccgtggccgccaggctccacaccaatcaggccgacgtcggtttcgttgatgaaatctgcaaacataccgatggcattcgaaccaccgccaacacaggcgataacggcatccggcaggcgaccttctctttccagaatctgcgctttcgtttcttcgccaatcatccgctgaaactcacgcacaatggtcgggtaaggatgcgggccagctgcggtacccagcatatagtgcgcggtttcataactgccggaccagtcgcgtagcgcctcattacaggcatctttcagggtcgcggaaccgctatgtaccgggatcacttccgcacccattaagcgcatccggaaaacgttaggcgactggcgttcaacgtctttggcacccatataaatacggcatttcaggccgagcagggcgctggcaagggccgacgccacgccatgctgaccggcaccggtttcggcaataatttcagttttacccatccgcttcgccagtaaagcctgaccgagtacctggttagttttatgcgcgccgccgtgcagcaaatcttcgcgcttcagatacagcgtggtgttcgtcccggctgtaatgttctggcatttggtcagcgcggttggacgcccggcatagtttttcagcaggtcgttgaactgagcctgaaattcaggatctttttgcgcgctgacaaaagcttcttccagctggcgcagagcaggcatcaggatttgtggcacgtacatgccgccaaactcaccaaaataggggttaagtaatgttgtcattgttcctttccttaatatgcgcgcagcgtctggaaaaccgaggccaaaagacgtgcgtctttgatacccggttgcgactctacagcagaattaaaatcaagcccggcgcagccggtttgtgccgcttccacgcagttatctgcgcctaagccccccgccagcagaacgttgccaagcgattgaccatttaatagtgaccagtcgaaacgttgtccgctcccgccctgaccgttgtcgaatacatatttatcgatgtgctgaaaatcgcgcgcgggaagagtttcaccgacacttaaagccttccagatggcgacgtgtgctggcagagcctcacgcagagtgtcgatatacagctgatcttcattaccatgcagttgcactgccgccagcgataacaccttagctttgtccaccacatcggcaatatcgtgattgcggaacacgccaacatactgcaacggtgccgcagccatcacttcctgcgcctgttcaacgttgacgcaacgcggtgatgtcgcaacaaaaatcagcccaccgtaaatcgcgcccgcgtcataagctgctttagcatcttgttcacgcgtcaggccacatactttattctcacccagcaacacccgacgcacggcggcgttcaaatcgtcatgggccatcaacgccgaaccaatcagaaagccgttagtgaagtggcttaactcgcgcacctgagcgtaagtattgatgccggattcgctgattaccgtcacgttgtgccccagtttcggcgcaagctcgcgggtacggttgagatcaatcgacaaatcgcgcagatcgcggttgttgatgccaacgacctttgctcccaatgcaatggcgcgctccagttcctcttcattactgacttcggtcagcacacccatctccagactgtgagcgacggtggcaagctggcgatattgttcgtcatccagtactgaaagcattaataagcaggcatcggcctggtaatagcgcgccagatagatctggtaaggatcgataatgaagtctttacataaaatcggctgcggggcgatttggctgacgatggggaggaaatcaaagctcccctgaaaatatttctcatcagtcagcactgaaattgccgaagcgtaatgtttataaatggcggcaatgcgtgccggatcgaaatcatcacggatcacgccttttgacggcgaggctttcttgcactcaagaataaacgccgtgcgtgcaccctgtagcgcatcataaaaatgtcgcgtgctcggctgaatctcattctgaaaactggccagcggttgctgctgtttgcgggtttctacccaaatcgccttgtctgcgacgattttcgctaaaacggtttgcatcatttaccctcgtgccgccagtgcggtgactctgtcgtaagcggaaccactgcgcagtacctcaagaacggtttgcgcattggcttgcagatcttcatggccatgcaggcgcattaacatggcgacattcgccgcgacggctgcttcgtgagcggcgtcgcctttaccttgtaacaaacgtgttaaaatgtcacggttttcttccggtgttccgcctgccagttgctcctggtggtagggtgtcaggccaaagtcttctgcggtgagctgatagcttttaatttcgccgtcatgcagttcggcaacgattgtcggcgcgtgtaatgaaacttcatccatcccgccgctgtgcaccaccgccgcgcgttgataccccagcacgcgcaaagtttcggcaatcggcagcaccagttccggactataaacaccaattagcgccagcggaggatgcgccgggttaatcaatggccccagcacattgaacagtgtgcgggtttttagtcgctggcgaaccggcattgcatggcggaatccggtgtgatatttcggtgcaaagaggaaacagacgcctaactcatccagcgcctggcgcgatttatcggcgttcatatcaagattaataccgaacgccgccagcagatccgacgagccggatttactggagacgctacggttgccgtgtttcgccactttcagcccgcaggccgcggcgacaaacgcactggcggtagaaatattgatgctgttgctgccgtcaccgccagtaccgacgatatcggcaaacagataatccgggcgcgggaacggcgcggcgttttccagtagcgcggttgccgccccggcgatctcattcgggtgctcaccgcgaattttcatgctcaccagcgccgccgccagttgttccggcttcagctcgccacgtaccaccgctgaaaacagctggtggctttcttgttggctaagcgtctgggcctgatacagtttttccagaatcggttgcagcgtgttggttggctttagtttctgctgcgcccaggccagcgtttgttccagcaggcgagcgccctgggtagtaagaatggattccggatggaactggaatccacaaacgcgatccgcatcatgacgcaccgccatcaccatgccattaaaatgggcgttgatggttaaaccggccggaatattactgccaaccagcgagtgataacgcgccactggcagcgggtttgttaatccggcaaacatcgcctgaccgtcatgttcaatgctcgacgctttaccgtgaagaatttcgcccgcctgaccgacatagcccccgtaagcttcgacaatcgcctgatgtccgaggcaaatgccaataattggcagcttgccacgcaagcgggtgaggagttccggcatacaaccggcttcgctcggcacaccggggccaggagaaagcatcagcaccggattgctcatcgtcgccaggcgttcaattaaggtctgcgccggaatatggttgcggtaaatcaccacgttatgaccattgctgcgcaactgatctgccaggttgtacgtaaaagagtcgatattatcgagcagcagaatgtcagccattagaacgtctcctgtgcatgatgcgcggtggcaatagcgcgcagtacagcgcgggctttattacgggtttcgtctgcttccgactgcggaacagaatcaaggactacgccagcaccggcttgcacggtggcgataccgttttccaccagcgccgagcggatcacaatgcaggtgtcgagatcgccatgcgcggtaaaataacctaccgcgccgccgtagctgccgcgtcgacgaccttctgcttcggcaattaactgcatagcgcgtactttcggtgcaccgcttaacgtccccatattcatacaggcgcggtaagcgtgcagggcgtcgagatcgtggcgcagctcaccaacaacgcgggagaccaggtgcatcacgtaagagtaacggtcaactttggtgagatcggcgacgtagcggctgccgggtgtgcaaatgcgtgccaggtcattacgggcgagatccaccagcatcagatgttcagaaagctctttatgatcggtgcgcatttccagttcgatgcggctgtcgaggtctctatccagtgaaccatcggcacgacgaccgcgtggacgtgttccggcaatcgggtaaatctcaatctggcggctggtggcgtcatacttgagcgaactttccggcgatgcgccaaacagggtgaaatcattatcctgcataaaaaacatgtacgggctgggattactctttttcagcacgtaataggccgccagcggtgacgggcagggcagagagaaacggcgagatggcaccacctggaaaatttctccggcgcgaatcgctttttgcaacaaacgcactacgccaccgaactcttcatcgctctggttacattcacaacgcatatgcggcacggaaaccaccggcagaggcggcgcggcttcggtcagttgctgacgtagttcgttaaggcgagcagtgagacgttgtttttcttcttcattcggagcaaacaggctggcctgaatacgggtgctttttttctgatggtcaatcaccatcagcgtttcagcgagataaaaacagaaatcagggcagttattttccgctgacagttgcggtaaatcttcaaatcccgccacaaggtcataagagaacaggccgccgaagaacattgcttctcgttcttccttcggtacattcaacagattctgtaataagcggaaagcgtcaaaaatcgaaagggagcataagcgggcgtcttcatccagcagtggactgacaggcgggaagcgcagtacgcggcagtttggtgattgttcattttccacacccgcaggcagggcgttatccagtagtgccagcagggcttcgccattgccggaaagtgcctggattgtgacggtgtcacctaatgctgtaatgcgcagcgcactgtctaccagcagcaggctttttaaatcatctttgctgtcgatatctgcggattccagtagcagcgttgccggacgatccccacacaactggtgaaaaagcgcggttgggttgtcgcgataagcgcctacgcaggttagcagttcgagagtcggtttttgtgtttgcattgttattctctaattttgttcaaaaaaaagcccgctcattaggcgggctgggtatctgattgctttacgcatggtgaatacactgcccgtttcaggaagtgcgccaccaacctttcagtacgaaaattgctttcattgtcgataccctttttacgtgaacttgcgtactagttaaatggttcgatgattaattgtcaacagctcatttcagaatatttgccagaaccgttatgatgtcggcgcaaaaaacattatccagaacgggagtgcgccttgagcgacacgaattacgcagtgatttacgacctgcacagccataccacagcttccgatggctgcctgacgccagaagcattggtgcaccgtgcagtcgagatgcgcgtcggcaccctggcgatcaccgaccatgacaccacagctgcaatctcaccagcaagagaggaaatttcacgttcgggactggcgctgaatcttattcccggcgtggaaatctccacggtctgggaaaatcatgaaattcatattgtcgggctgaatattgatattactcatccgctaatgtgtgagttcctcgcgcagcagacagaacggcgcaatcagcgggcgcagctcattgccgaaagacttgaaaaagcgcaaatacctggggcgctggaaggtgcgcaacgactggcgcagggcggcgcagtgacgcgcggtcattttgcgcgtttccttgttgagtgcggcaaagccagttcaatggcggatgtctttaaaaagtatctggcgcgcgggaaaaccggatacgttccgccacagtggtgtacaatagaacaagctattgatgtcattcatcattctggcggtaaggcggtgctagctcatcctgggcggtacaatcttagtgctaaatggctgaaaagattggttgcgcattttgccgaacaccacggcgacgcgatggaagtcgcgcagtgccagcaatcgcccaatgaacgcacccagctggcgacacttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatgagccagtttttttatattcatcctgataacccgcagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgtcgataacgttgcgtttcgtttgatgaaaaacaacacgccgggcaactataccttcatcctgaaggggacgaaggaagtgccacgccgtctgttgcaggaaaaacgcaaaaccatcggtatgcgtgtgccttctaacccgattgcgcaggcgctgcttgaagcattgggcgaaccgatgctttccacttcgctaatgctgccaggcagcgaatttaccgaatccgatccggaagaaattaaagaccgtctggaaaaacaggtggacttgattattcacggcggttatctcgggcagaaaccaacaacggttattgatcttaccgatgatacgccggtcgtggtgcgtgaaggcgtaggtgatgtgaagcctttcttataacaaattgcgttccacggatggaaaatgatggcagggatatatcgctgcattttgctgttgatagttgggctttttttctcttcgttgagttatgcgaaaaacacggagatcccttcttatgaagaagggatctcgctctttgatgttgaagccactctgcaaccgaatggggtgctcgacatcaaagagaacattcattttcaggcgcgaaatcagcagattaagcacggattttatcgtgatttaccgcgactctggatgcagcctgatggggacgctgcactgctgaactatcatattgttggcgtcacccgtgatggtattcctgaaccctggcatcttgactggcatatcgggttaatgagtattgtcgtgggcgataaacaacgtttcttgcctcaaggcgactatcattatcaaattcattatcaggttaaaaatgctttcctgcgtgagggggattctgatctgctaatctggaacgtgaccggtaaccactggccgtttgaaatttataagaccctattttcactcaagttgcctgatattgcgggtaatccatttagcgaaatcgatctctttactggagaagagggcgacacatatcgaaatggccgcatccttgaggacggaagaattgaatctcgcgatccgttttatcgtgaagatttcacggtcctctaccgctggcctcacgcattacttggtaatgccccggctccacaaacgacgaatattttcagtcatcttcttttaccctctatgtcatcgttgttaatttgctttccgagtctgttcctggcgtgtggatggttatatctctggaagcgcaggccgcaatttacgccggtagatgtgattgaaaccgatgtcattccgccagattacacgcccggcatgttacgtcttgatgcgaaactggtttacgacgataaaggtttttgcgccgatatcgtaaatctgattgtgaaaggaaaaattcatctggaagatcattatgacaagaaccagcaaatcctgattcgtgttaatgaaggcgcgaccagaaataatgcggtattactgcccgcagagcagttattactggaagcgttatttcgtaaaggcgataaggtcgtgcttacggggagacgcaacagagtcttacgcaaggcatttttacggatgcagaaattttatctgccgcgtaaaaagtcttcgttttaccgacctgatgcgtttttgcaatggggcggaatggcaatattggcggtcattctctacggtaacctgagtcccgtaggctgggcaggaatgagtctggtaggcgatatgtttattatgatctgctggcttcttactttcttattttgttcccttgatcttttgtttgcccgcgatgatgacaagccttgcgttaatcgtgtcatcatcactttgtttttaccactgatttgttcaggtgtggctttttactctctctacatcaatgtcggagatgtattcttttactggtatatgccagcgggttattttagcgcggttttcctgaccggttatctcactggcatggggtatatttttctgccaaagtttacccaaactgggcagcaacgttatgcccacggtgaagctatcgttaactatcttgcgcgtaaagaggcagcaacacacagtgggcggcggaggaaaggggaaacacggaaactggattacgcgttgttaggttgggctatatcggcaaatttggggagggaatgggcgttacgcatcgccccttcgctttcttcggcgatttgcgctccagagattgcccgtaacggcgttttattctcattacagacgcacctgagttgcggggtctataccagtttgttggggcggagctattctggtggtggttctggcgctggtggcggaggcggtggtggctggtaatcaagctgatgttaatcgaaacaagctttaaccataaagatagtgtagtatgttgcgcctcaaagccaggcaagttaaaacgtcgagtcgtttacttaaggcctgaagagttcaaacagactttactatcagtgagtcagatgtaagttctgactcattgttgcacaaaagcatatcagacgcctgggaaggcgacaccaaaaggaagctctatgagcgaaaagctacagaaagtgctggcgcgtgccggccacggttctcgccgtgaaatcgaatctattattgaagccggtcgtgtgagtgttgatggcaaaattgctaaactcggcgatcgcgttgaaattacccctggactgaaaatccgtatcgatggtcatctgatttcggtacgtgagtccgctgaacaaatttgtcgcgttctggcctattacaaaccggaaggtgagttgtgtacccgtaacgatccggaagggcgtccaacggtgtttgaccgtctgccaaaactgcgtggcgcacgctggattgccgtaggtcgtctggacgttaacacctgtggtctgttgctgttcaccaccgacggtgaactggcaaaccgtttaatgcatccaagccgtgaagttgaacgtgaatatgccgtgcgtgtatttggtcaggttgacgacgcgaaactgcgtgatttgagtcgtggcgtgcagctggaagatggtccggcagcctttaaaaccatcaagttcagcggcggcgaagggatcaaccagtggtacaatgttactctgaccgaaggccgtaaccgtgaagttcgtcgtctttgggaagcggtaggtgtgcaggtgagccgcctgattcgtgttcgttacggtgatatcccactgccaaaaggtctgccacgcggtggctggacggagctggacctcgcccagactaactatctgcgcgaactggtggagctaccgccagaaaccagctctaaagtcgctgtagaaaaagaccgtcgtcgcatgaaggcgaatcagattcgtcgtgcggtgaaacgtcacagtcaggtgagcggcggtcgtcgttctggtggacgtaataataacggttaatttaagttaagtataaaataaaggccctgcggggccttttcttcatttgaagtatgataaatagtcgcagtattttaatttaatttcatacttgcttatgaataataccaggaaatagccacattactatttaattatctgagataaactcaacgtcaagaggtgggttatgattagatatagtggaatatttctatcgctgttaatgctttcaggttgtgcaaccgaagcattgaagaatgaacaagctgaaactgttattactgcgggtaacaaggcggttgcggcgaatgcaagtttctttaaacaatactatgcttctcgtgaaaacttccttgttaatttttatgcgactaatccggattgtgcattgcgacctgattatgaaacgattatggaaaataatactaataaagagtccttatgtttgcaatcagagaaagggggcaaaacatcgtataaagatattactaaaattcaattggcaacaacagaaaaacaaaaactactggcttcacttgaggtcgttaacagtatgagctcctatgtggagttgttgacggtgggtatggatgttgaggatagtaaacaaattatattacttaatcaggcgctcgatcacgcaaacaacgcccaaaaactacttggcttttcagaaggtgaagaactgactaagtcagctgtggctgttaaagatttagttcaatatttcaatggattatacaaagagaagattaaatcagaaaatgttggtaaagcggtaggtagtgactggccacgacttcaaagaaatttacaagatttacttgatgatatagcaacgaaacagcagcaaatggatcggaataattttgcgaacatcagtaataatttttattactataataaggcccgggcaaatactaaaaatatagaatttaagacattaaagagcaggcaggaatttttgagtgcagtaattaatcttaatgaaagcagattgcgttcatctgatccggcggctccagcaatacaagctattaatgccttcatggataaaggaaatcatctacaagatttatactctaataaatctctttcaaaagcggatttagagcgtaggaatgagatcctgcgtgctcaagttattagtggtcttcaggcgtcagaggaactggcaaaacttcttattgccagcggagttatgttataggaggtcattatgaacgatgtgcaaaatcgacgaatactggcattgctcaatatgctgtactatgccttaggaaaccgaacaacttgcgatatatgtcacaaatattttattctggttttgtcggtaatgaataatctgacaattaattatggctcgcaaacgtcaccagaactgactggtattagttatgaagatgctaatgatttgatcactgaattaataatgtttattgaagacgtcaatgcggataatgatatggaatatcccgcacacttgaataaaattcaagttcttcttaattttgccgtggctaattaagccattcagtatctaaaattagcacctcaagaggcgatcttttgaggtgctttcacttaataatcaatccctatttgcgccttaacacctgcatcaaacgcatgtttgatggggcgcagctcacttaccgtatccgccagttcaagaatatcccgatgacaaccacgacctgtgataatcaccgtctgttgatgtggacgttcatttaacgcctgaatcacgtcttccagtggcaaataatcatacgctaccatatatgtcagttcatcgagcaaaaccatatccagtgaggaatcagccagcatccgctttgcatgttgccagacttcgcggcaggcggcggtatcagactctcggttttgtgtatcccaggtaaagcccgttgccattacctgaaactcaacgccgtgtggctccagcagatttcgttcaccattaggccaggtgcctttaataaactgcacgacgcccactttttttccgtgaccaactgcgcgtgttgccgtaccaaatgccgcggtggttttgccttttccattgccggtaaagacgatgataataccgcgttcatcctgggcctgggccacacgagcatctactttttctttcactcgctgctgacgctgttggtagcgttcatcactcattgggaaattcctggtttacggcccggttgggcgtcaaaggtcatgccggttttacggcggctgtcatcgcccatcagccagaggtagagcggcatgatatcagcgggggttttaagtttctgtggatcttcggtcgggaaggcgctggcccgcattgcggtgcgcgtaccgcctgggttaatgcagttgacgcgcaggcgctgctgatattcatcggccagtacctgcatcatcccttcggtggcaaatttcgacgctgcatatgcgccccagtttgcacgcccctgacgtccaacgcttgatgaggtaaagaccagtgaaccggcatccgatttgagtaataaaggaagcagtgcctgtgtgagcataaaggtggcattaacgttgacctgcatgacgtcctgccagacctgcggatcttgttcgctcattgggcaaacatcgccgagcaatccggcattatgcaaaacaccatccagacgcggataattaacggcaatgcgctgtgccagttgttggcaatcttcggacgtgcaggttagcaaatcgagaataaaccactgtggctgacgtccaatttcttcgtttatgtggctggctacctgacgtaatttttcttcattacggcccaaaagaatcactgtcgcaccatagcgtgcatacgtcatcgctgcttcacgaccaattccatcgctggctcccgtcaccaggataatgcgatcattgagtaaatcttgttttggctggtaatgcatggctactcctcaacgacgttgtctgtcgcgctgccagtgtactttatgactttggggctttatgcctgaaacagaagggcatttcaatcagcctggggcgataacaccgcaaaatggatactttgtcatactttcgctgcaataacatctctgcgagacggctaaacatgcctgttgtaaactgtgagccaaagcgttgtttaaccaaggtggggactcgtggaattgttgtctgaatatggtttgtttttggcgaaaatcgttaccgttgtgctagcgattgcggcgattgccgccattattgtcaatgttgctcaacgtaataaacgccagcgtggcgagttacgagtcaacaatctcagcgaacagtataaggagatgaaagaagaactggccgcggcgctgatggacactcatcagcaaaaacagtggcacaaagcgcagaagaaaaagcacaagcaagaagcgaaagccgcaaaagcgaaagctaaactgggcgaggtggtaactgacagtaaaccccgcgtctgggtgctggattttaaaggcagcatggacgcccatgaagtgaactcgctacgtgaagagataacggcggtactcgcagcattcaaaccgcaggatcaggttgtgctccgtctggaaagcccaggtggcatggtgcatggttacgggttggcggcttcgcagttgcagcgtctgcgtgataaaaacattcctttaactgttacggtagacaaagtcgctgccagcggcggttacatgatggcctgtgtggcggacaaaattgtttccgcaccgtttgctattgtgggttccattggggtggtggcgcaaatgcccaactttaaccgcttcctgaaaagcaaagatattgatatcgaactgcacaccgccgggcagtataagcgcacgctgacgttgctgggtgaaaataccgaagaagggcgggagaaattccgcgaagagttgaacgaaacgcatcagttatttaaagattttgtgaagcgtatgcgtccgtctctggatattgaacaggtggcaacgggtgaacactggtacggacaacaggcagtagagaaaggcctggttgatgaaatcaacaccagtgatgaagttattcttagcctgatggaaggccgggaagtggtcaatgtacgctatatgcagcgtaaacgactcattgatcgattcaccggcagcgcggcagagagcgccgatcgattgttgttacgctggtggcagcgtggacaaaagccattgatgtaaaagacaaacgcgagggtaagacctcgcgttttgctttaatcaaccagatgatatttttctgaaagcacatgggccaggtgtttgaacatattaaacaccgcggtgcttttggcagttggtaatccttgttcatctaaaaagtagtcgccggtaaataccagcacgccattacgctgcgtgacgccggtggcttcaatccctgcgagcgtatcctcatgctcacgaatgattttgttggcctctttcaacagcgtttcgcggtcgatgggttgtgtctctttgttcattatttactccttaaacaaggacattagtctacgccaggcatggcttgcagacaaatataccacgctggtggcaagagcgccttactggcaactttggattttgcatgctaataaagttgcgtatcggattttatcaggtacagtgtgacgctttcgtcaatctggcaatagatttgcttgacattcgaccaaaattccgtcgtgctatagcgcctgtaggccaagacctgttaactcagtcacctgaattttcgtgagcagagtcacgacaaggggttgatatccgcagagagcgagtccatatcggtaactcgttgccagtggaaggtttatcaacgtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgtcggtcacatccgcgatttgccgaccagtggctcaactgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagttattggtggtgatgatgcgcgctatagccgagtggtgtttaacgaaattactaaaaacgcgatccgccaggcatttaacaaaccgggtgagctgaatattgatcgtgttaatgcccagcaggcgcgtcgctttatggaccgcgtggtggggtatatggtttcgccgcttctatggaaaaagatcgctcgtggtctgtctgccggtcgtgtgcagtcggtggcggtccgcctggtggtcgagcgtgagcgtgaaattaaagcgttcgtaccggaagagttctgggaagtcgatgccagcacgaccacgccatctggtgaagcgttggcgttgcaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttggttttggcgtgaaaaaaaccatgatgatggcgcagcgtttgtatgaagcaggctatatcacttacatgcgtaccgactccaccaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgttgaaggatatggaagcagatgcgcagaaactgtaccagttaatctggcgtcagttcgtagcctgccagatgaccccagcgaaatatgactccacgacgctgaccgttggtgcgggcgattttcgcctgaaagcacgcggtcgtattttgcgctttgatggctggacgaaagtgatgcctgcactgcgtaaaggcgatgaagatcgtatcttaccggcagtcgataaaggcgatgctctgacgctcgttgaactgaaaccagcccagcactttaccaagcctccagcccgtttcagtgaagcatcgctggtcaaagagctggaaaaacgcggtatcggtcgtccttctacctatgcgtcgatcatttcgaccattcaggatcgtggctatgtgcgagtagaaaatcgtcgtttctatgcggaaaaaatgggcgaaatcgtcaccgatcgcctggaagagaatttccgcgagttaatgaactacgacttcaccgcgcagatggaaaacagcctcgaccaggtggcaaatcacgaagcagagtggaaagctgtactggatcacttcttctcggatttcacccagcagttagataaagctgaaaaagatccggaagagggtggtatgcgcccgaatcagatggttctgaccagcattgactgcccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggcgaagacgctgaaaccaatgcgttgcgcgcaaaacgtcgttgcccgaaatgcggtacggcgatggacagctatctcatcgatccgaaacgtaagttgcatgtctgtggtaataacccaacctgcgacggttacgagatcgaagagggcgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattaccggagctgccgtgcgaaaaatcagatgcctatttcgtgttgcgtgacggtgctgccggtgtgttcctggcggccaataccttcccgaaatcgcgtgaaacgcgtgcgccgctggtggaggagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaagggaaaaaataacctttaattccgtctggtttttataaacaaagggtcgcgaaagcggcccttttttattgcatattattttttcttcacacctatacactagggctataaatgatatagtggttatagttagcaccttttttattattaaatcgtattagtcacccgcctggtgtggcgaaaaaacgatgttctgatggcgtctaagtggatggtttaacatgaaattacaacaacttcgctatattgttgaggtggtcaatcataacctgaatgtctcatcaacggcggaaggactttacacatcacaacccgggatcagtaaacaagtcagaatgctggaagacgagctgggcattcaaattttttcccgaagcggcaagcacctgacgcaggtaacgccagcaggacaagaaataattcgtatcgctcgtgaagttctgtcgaaagtcgatgccataaaatcggtcgccggagagcacacctggccggataaaggctcgctgtatatcgccaccacgcatactcaggcacgctatgcgttaccaaacgttatcaaaggctttattgagcgttatcctcgcgtttctttgcatatgcaccagggctcgccgacacaaattgctgatgccgtctctaaaggcaatgccgatttcgctatcgccacggaagcgctgcatctgtatgaagatttagtgatgctaccgtgctaccactggaatcgggctatagtagtcactccggatcacccgctggcaggtaaaaaagccattaccattgaagaactggcgcaatatccgttggtgacatataccttcggctttaccggacgttcagaactggatactgcctttaaccgcgcagggttaacgccgcgtatcgtcttcacggcaacggatgctgacgtcattaaaacttacgtccggttagggctgggggtaggggtcattgccagcatggcggtggatccggtcgccgatcccgaccttgtgcgtgttgatgctcacgacatcttcagccacagtacaaccaaaattggttttcgccgtagtacttttttgcgtagttatatgtatgatttcattcagcgttttgcaccgcatttaacgcgtgatgtcgttgatgcggctgtcgcattgcgctctaatgaagaaattgaggtcatgtttaaagatataaaactgccggaaaaataatttcttgcgttattttcggcaccttttatgtagcgaaggtgccggaatatattctcctttgttacttatttgtatccggtgcacaatatttttatccctcatatttatagggtaaattacctgtaaagtagtgtctaattacacacctcgcaaactccagttttcaaatatctatttcagttcaaaagattgaattattcactggagacgattcgtaaattcgctggatttttgactaaagtttctttaggatttgtctcatcgtatgattaattacaccaatcgttcaacgtcttgctgataagtgatggcgattatatgaggttagcaatgccttctggaaatcaggaaccccgccgcaatcctgaattaaaacgtaaagcctggctggcggtttttcttggttctgcacttttctgggtggttgtcgcactgtttatttggaaattgtggggataactatggtcggtcaggagcaactggagtcgtcaccattatgtcagcatagtgacaatgaaccagaagcaaaacgggaatgttccgtcgttattccagacgactggcaactaacatcgcagcaacaagcctttatagaactgtttgctgaagatgatcagccgaaacaataattatcatcattcttattacccatttttaatgaattacagggcttttaatacaccgcagcaataacaggttgagttatctcaatacaaagtaataaccgttaagggtgtagcctatgatcaacacaaatatgaaatattggtcctggatgggcgcattttctctgtcgatgctcttctgggctgaactcctctggatcattactcactgatccctgaccccgctgtttgctttgcctcaaggtttctcctcttttatcaatttgggttgttatcaaatcgttacgcgatgtttgtgttatctttaatattcaccctgaagagaatcagggcttcgcaaccctgtcattaaggaggagctatgtcgtcaaccctacgagaagccagtaaggacacgttgcaggccaaagataaaacttaccactactacagcttgccgcttgctgccaaatcactgggcgatatcacccgtctacccaagtcactcaaagttttgctcgaaaacctgctgcgttggcaggatggtaaatcggttaccgaagaggatatccacgcgctggcgggatggctgaaaaatgcccatgctgaccgtgaaattgcctaccgcccggcaagagtgctgatgcaggactttaccggcgtacctgccgttgttgatctggcggcaatgcgcgaagcggttaaacgcctcggcggcgatactgcaaaggttaacccactctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaggcgttcagtcggtttagcgtcgtgccgccaggcacaggcatttgccatcaggttaacctcgaatatctcggcaaagcagtgtggagcgaattgcaggacggtgaatggattgcttatccggatacactcgttggtactgactcgcacaccaccatgatcaacggccttggcgtgctggggtggggcgttggtggcatcgaagcagaagccgcaatgttaggccagccggtttccatgcttatcccggacgtagtgggctttaaacttaccggaaaattacgtgaaggtattaccgccacagacctggttctcactgttacccaaatgttgcgcaaacatggcgtggtggggaaattcgtcgaattttatggtgatgggctggattcactaccgctggcggatcgcgccaccattgccaatatgtcgccagaatatggtgccacctgtggcttcttcccaatcgatgctgtcaccctcgattacatgcgtttaagcgggcgcagtgaagatcaggtcgagttggtcgaaaaatatgccaaagcgcagggcatgtggcgtaatccgggcgatgaaccaatttttaccagtgtgttagaactggatatgaatgacgttgaagcgagccttgcagggccaaaacgcccgcaggatcgcgttgcactgcccgatgtaccaaaagcatttgctgccagtagcgaactggaagtgaatgccacgcataaagatcgcctgccggtcgattatgttatgaacggacatcagtatcagttacctgatggcgctgtggtcattgctgcgataacgtcgtgcaccaacacctctaacccaagtgtgctgatggccgcaggcttgctggcgaaaaaagccgtaactctgggcctcaagcggcaaccgtgggtcaaagcgtcgctggcaccgggttcgaaagtcgtttctgattatctggcaaaagcgaaactgacaccgtatctcgatgaactgggatttaaccttgtgggatacggttgtaccacctgtattggtaactctggaccgttgcccgatcctatcgaaacggcaatcaaaaaaggcgatttaaccgtcggtgcagtgctgtccggcaaccgtaactttgaaggccgtattcatccgctggttaaaaccaactggctggcctcgccgccgctggtggttgcctatgcgctggcgggaaatatgaatatcaacctggcttctgagcctatcggccatgatcgcaaaggcgagtcggtatatctgaaagatatctggccatcggcacaagaaattgcccgtgcggtagaccaagtctccacagaaatgttccgcaaagagtacgcagaagtttttgaaggcacagccgagtggaaggaaattaacgtcacacgatccgatacctacggttggcaggaggattcaacctatattcgcttatcgcctttctttgatgaaatgcaggcaacaccagcacctgtggaagatattcacggtgcgcggatcctcgcaatgctgggggattcagtcaccactgaccatatctctccggcgggcagtattaagcccgacagcccggcgggtcgatatctacaaggtcggggtgttgagcggaaagactttaactcctatggttcgcggcgtggtaaccatgaagtgatgatgcgcggcaccttcgccaatattcgcatccgtaatgaaatggtgcctggcgttgaaggggggatgacgcgccatttacctgacagcgatgtcgtctctatttatgatgccgcaatgcgctataagcaggagcaaacgccgctggcggtgattgccgggaaagagtatggatcaggctccagccgtgactgggcggcaaaaggtccgcgtctgcttggtattcgtgttgtgattgccgaatcgtttgaacgaattcaccgttcgaatttaattggcatgggcatcctgccgctggaatttccacaaggtgtgacgcgtaaaacgttagagcttaccggggaagagaagattgatattggtgatctgcaaaatctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaacgagtatttgcttgccggttattttgcttccggcaagcaaattaattacacaatgcaagagggttatttgttcagcaaatgacccattttctcggctttggtatcgagataatgttcgttattggggttacgacctacaatcaacggtacgcgttcaataatattaatccctgcttcggtcagaatttcgacttttttcgggttattggttaacaagcggacttcattgacgccaaggagtttgaacatatcagcgcaaagagtgaagtcgcgctcatcagcggcgaagcctaactggtggttagcctctacagtatcgtaaccttgatcctgcagtgcgtaagcgcggattttattcagcagaccaatgttacgaccttcctgacggtgatacagcaaaataccacggccttcctcggcaatttgcgtcaatgccgcttcgagctggaagccacaatcgcagcgcaagctgaacagggcgtcaccggtcagacattcggaatggacgcgcgcaagtaccggggtatgcccggaaatatcgccatagactagcgcgacatgatcgtgtccggttgccagttcttcaaatcccaccatcaggaaatcgccccatggggttggcagtttggcttctgccacacgtttaagctgcatgaaattctccagataatgctggttctgtattggcttattttgccataacgagaaggggttcacctaatcacggcgcgtcgatcgttcacggaatggcacaaatctgtcaatttttcctggaactggcattttcagttatgattgtgggacttatcaaaaaggagaggccatgcgttcgattgccagacgtaccgcagtgggagctgcactattgcttgtcatgccagtagccgtatggatttctggctggcgttggcaacctggagaacaaagttggttactaaaagcggctttttgggttactgaaactgtcacccagccctggggcgtcattacacatttgattttattcggttggtttctctggtgtctgcgttttcgcattaaggctgccattatgttatttgccattctggcggcggcaatccttatgggacaaggcgttaaatcctggatcaaagacaaagtccaggaaccacgaccttttgttatgtggctggaaaaaacacatcatattccggttgatgagttctacactttaaagcgagcagaacgcggaaatctggtgaaagaacagttggctgaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgttggtctgggcaacgggagtcatgggaagccgcctgctgctcgggatgcattggccacgcgatctggttgtagctacgttgatttcgtgggcgctggtggcggtggcaacgtggcttgcgcaacgaatttgtgggccattaacaccacctgcggaagaaaatcgcgaaattgcacaacgagaacaagaaagttaacgctggttgattttccgaatttagcccttaaatcatcaacaatgcgcgtggatgccatttcgcagacggcgcgaaaatggtactttaaagggctattgcggtaagttgaccataatttattcgccctaaccacataacgggaagtaatgtgaaatatttactcattttcttactggtgttagcgatcttcgtgatttcggtcacgttgggcgcgcagaacgatcaacaggtgacgtttaattatctgttagcgcaaggggagtaccgtatttccacattgctggcggtattgtttgctgcggggtttgctatcggttggttgatttgtggcctgttctggctgcgagttcgtgtttccctggcgcgcgctgaacgtaaaataaagcgactggaaaaccagctttcacctgcgactgacgtggctgtagcgccgcactcgtctgcgtcgaaggaataactttctatgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggtaccgttgaagcccaccttacgctcggaaacctgttccgttcgcgtggcgaagttgatcgcgctattcgcatccatcagaccctaatggaaagcgcctcgctgacctatgaacagcggcttttggcgattcaacaactggggcgtgattacatggctgccgggttatacgaccgcgcggaagacatgttcaatcagctgaccgatgaaactgacttccgcattggcgcgctgcaacaactgctacaaatttaccaggctaccagcgagtggcagaaagcaattgatgttgccgaacgcctggtgaagctgggtaaagataaacagcgcgtcgaaattgcccatttctactgtgagttagctctgcagcatatggccagcgacgatctcgatcgtgccatgactttgctaaaaaaaggtgcggcggcagataaaaacagcgcccgcgtatccatcatgatgggacgcgtgtttatggcgaaaggagaatacgccaaagccgtcgaaagtttgcaacgtgtcatatcccaggacagagaactggtcagcgaaacgctggaaatgctgcaaacatgctatcagcagttgggtaaaactgccgaatgggcagaattcctgcagcgcgcggtggaagagaacaccggtgccgatgctgaattgatgcttgcggatatcatcgaagcgcgcgacggtagtgaggccgcacaggtctatattacgcgccagcttcagcgtcatccgaccatgcgtgtgttccataagttaatggattaccacttaaatgaagcagaagaagggcgtgccaaagagagtctgatggtgctgcgtgacatggttggcgagaaggtgcgtagtaagcctcgttatcgctgccagaaatgtggttttaccgcatacactctctactggcattgtccgtcttgtcgggcctggtcaaccattaaaccgattcgcggtcttgatggcctgtaatttttaaaaaaatccgactttagttacaacatactaattattgatgttctattgtgctccggcaccgacggcgcggaaaagcctgccagaggagaaatcgcaactgttaattttttatttccacgggtagaatgctcgccgtttacctgtttcgcgccacttccggtgcccatcatcaagaaggtctggtcatgacgttaactgcttcatcttcttcccgcgctgttacgaattctcctgtagttgttgcccttgattatcataatcgcgatgccgcgatggcctttgtcgacaagatcgacccacgcgattgtcgtctgaaggtcggcaaagagatgtttacattgtttgggccacagtttgtgagcgaacttcaacagcgtggttttgatatctttcttgacctgaaattccacgatattcccaacactgcagcgcacgctgtcgctgctgcggctgacttaggcgtgtggatggtgaatgttcatgcctccggtggggcgcgtatgatggccgcagcgcgtgaggcactggttccgtttggcaaagatgcaccgcttttgattgctgtgacagtgttgaccagcatggaagccagcgacctggccgatcttggcgtgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgatgctggtgaccagcgccgcattatgacgccagaacaggcgttggcggctggtgttgattatatggtgattggtcgcccggtaacgcaatcggtagatccagcgcagacgctgaaagcgatcaacgcctctttacagcggagtgcatgatgagtgattccaacagccgtctggtctactcaacggaaaccggacgtattgatgagccaaaagcggcccctgtacgccctaaaggcgacggtgtggtgcgtattcagcgtcagaccagtggacgtaaaggtaagggcgtttgcctgattaccggtgtcgctctcgatgatgccgaactgacgaaactggcagcggaactgaagaaaaaatgcggctgcggcggagcagttaaagatggaattattgaaatccagggcgataagcgtgatttattaaaatcactgcttgaagcgaaagggatgaaggtaaaactcgcaggcggctaacataaaaagccacggatatatccgtggctttcgaatattttactgtgtgtattattcagttatttcgtactgaacagaatcaagcgtattataattgcgagtcgataatcgacatttatttacgattatttaccgacctggtgaccaataacaccaccgacggctgcaccacctaatgtacccaacgtactgccatcggtcagtactgcaccgcctaatgcccctgcacctgcgccgattgcggtgttgcggtcccgtttagaccagttagagcaggcactcagagacattgccagggtaattgccagaacagccgcggtcatttttttgctcgttacaaacataatactctctcctgaatttatgattcacggaagtaagctctctataactataatagctaagaataagcctggtgaaattattccgtgaaatccgctcgcgcgcagggttatatcacgcaggtgataatgacttcctgttatatcgctgataataattttatatcttgagagtgttaataacaggtaaatagtcttaattatcaaccaggaatcatcttagagcggatgatttgccaaactgcaaatcatccgtagagaagggaaatggttaaatgtcaacgacgtgaacggtgagtttactttgttcaagatgcatcagatcgctggcgcgtattttcgaatcggtaatcacacgattgaatcgctcaacggggccgatggagtatgaatgtacagcaccaaatttcgagctgtcagtcaggactatcgcctcgcactctttttccagcacggcattgaccacatcggtacgcatcatatcgcgaccggtaaacccagtttcaggttgccagccatcaataccaataaatgctttgctgaaatgcacttgttggatgcactggcgtgtcaaagggccaaccatactttcgctttttttctggtacacgccaccgagcaaaatgacttcacaaggcgcgtctttcagcaaatgcgcgatgtagctgctgaccgtgatgatagtgacatttttcttctgctcgcccagagtcctggcgagcagggcattgctgctaccattttcgataaagatggtttcgcccggttgaaccagtgacgcggcaaactcggcgagttcacgcttcagcgtatagttgctcatcatacgggtttcgacgtcatcactatcaagcgaaactgcaaaaccatgtgcacgtcggaggtaactcagtttttcgagggtgttgagatcctggcgaatggtaacttcagaaactccagtggcttttgccagatcggttacgctaacctgaccctggtcaatgaccatctgtagaatagtttgttgtcgggaattcatcgctgtaattcttataacgttataatactaaataaaaaaatactgacgcgccgggcatcctcaaataggaaaacctgaaggcatgattgttagatctcccacggtgccttcgggatgtctggcgtagattcagcaacctggcgcaagagttctgctttaagtatctcgagattatggatcgcagagtggtaatcgcctgccacaaggatatctaacacaatatcaatacgttcggcaacgcgctgggcatcaaattcagacatcaaggacatccttatagcaaaaggggaaaaatgaataatgcaaaaattgccgctaaaagagaagtgtttaacagcaacggctaattatcatccgggaatacgatatataatgacggaatatagcgctaagtatatatattcatctacttatgtgcgcttcaggtagcgtttataccagcgttcgaaggcaacggcgggcatcggtttggcaaacaaaaatccttgtcgctcattgatcccgttcttggttaaaaaagcatcttcctttgcactttctacaccttcggcgatcacctgaagattcaatgcctgggccacagcgacgatcgcccggaccagtgattgcgagacaggctgtttgtgaatatcccgaacaaaaacctggtcaagtttgatggcatcgatcggaaagcgcgccagttgcgaaagtgaagagtagccggtaccaaaatcgtccagatgaacttgcgcacctaatcggctaaattgttgaataacagacagtgccagttcatcattctcaatcaggcagctctccgtcagttcaacatctatagggcagtattcaaaattgagttcctggagaacctgtttcagggcggtgaaaatggtttgatcggcgagctgacgtgcagaaatatttaccgccactcgcaggttaatgcctttatcccgccacttcgctacctggcgtacgacatcgagaatcacccaacggcctaaaggcacaattagccctgattcttcggcgtaggaaatgaagtccaacggtggaatcaacccacgttcaggtgactgccaacgtactagtgcttccagactgcgcacttcgccacgccaggttattttcggttgatagtgaataaccaactgatcgttttccagtgctttacgcaagttggtatccagccagagatattcaaatacccgctgattcatttctggggtaaaaacgcaaaattgtcctcgtccgccttccttcgctgtgtacattgctgtgtcggcgtgacgaataatagccgcgctgtccgaaccatgttcgggagagagtgaaatacctactgaacagctggtataaacttcaattaaaccaatgcgaaaggggagtcgtaagcgggtcaaaattcgtgatgccaatgcttccagcgcgctttgtgaggtattggatgccagtaccagaaactcatcgccacctggacgcgccaacacctggtcatgttcgagacagcttaaaatagccaatgacacgtcgcgtaataactggtcaccaaacaaatgcccataggcgtcgttgacctttttaaaattatccaaatcaagatacacaaccccaactttattgttatctgcctgattaatagcgtgatcgattaactcctgcattgcgttacgattcggcagtccggtgatactgtcggtatttgccagaatacgcagtcgctcctgagcgcggcgctcttcggtaatgtcggtgccggaacagattaaaaaaatctcgtttttgccactgccgctgtggacaaatttattgcgaaacagaaacagccgctggcctttacgtgttggtatccacagttcgacttcatatgcattgccgcttcgaaaaaatacacggttattgcgcctggatgccgcagcttcacgacgactcataaacagtttaaacacgctttgcccaatgacgtcgtgttctttcaaccccgtgtaatcttcacataaccgattgaagcgctggatattcccccggctgtcgagaatcactattgcggaatgtgcttcagaaactacctgctcagcaaaggaaagcccatgtgataaatcacgagcaaccgccggtgtgtcatgccatgcagacgcgttgcctccccattctcgtttattgatttttcgtcctaccagatgcacagaaagatcgctttcatcgacggtcagactcatcatcaggctggaggtgatgaccgtcatttccctgatgcgagcagcctgttcggcagatagttgcaaaatacgatcgggttctgtgatttcggtggtagaaaagcgcaaaacatcgctgctttccgtcaaccgccagtatggattgtgcgatccgagaaagttgtacaacgttgtggactccctaacggttttcatgatgcatatcctccggttaacagcggagtccgcagttaaataaaaggaacaacatgacttacatgaaattaacggcggctaaacacattgtttttttatatatttatttgtaatccagttttggaaaaacgccagttttcaaacgaaagtcagttaaaaatctgccgggatatgacgaaggttgagcggggaaataaacggcccatccatgaggaatgggccgtgaaaggagattacgcgactgggcgcgcaataatgctgcgggtttccatgcggacttcggcaatggtgacgtcaataacgtcagtcactttgtaagccgtttcacctttaatttgtacagtgccgttttcctggctgcaaaccagttcatcgcgcacagcgtgtaagaaaggtgctggaataaaggcgatagcgccgttatcaaccaaacgaacacgcatgccgccacggctgatatcgacaatttccgccgcgaaacgggtgtcggtcccggctttgtctttcaggaagcgtgcgtataaccagtcgccaacatcacgttctgccatccggttgagacggcgacgctcggccatttggacagtgatttcatcctgtggacgcgtcgcagtttcgcctttgataaccgctttcagcagacggtggttgatcatgtcgccatatttacggatcggcgaagtccaggtggcgtatgcttccagaccgaggccaaagtgaggaccgggttcagtgctaatttcagcaaatgactggaagcgacgaatgcggctgtcgaggaaaccagttggttgcgcatccagttcacgacgcagtttgcagaaaccgtccagcgtgagcacttcttcagcatcgacatgcagaccgtgcgttttcagcaacgctgccaacgcgtcggcattcgccggatcaaagcccatatgcacgttatagatgccaaaaccgagcttatcgcgcagtacgcgggctgcacaaatgttagcggcaatcatcgcttcttcgacgatacggttggcaatgcgacgaggctcggcgacgatatccagcacttcacctttttcaccgagaataaagcggtaatccgggcgatctttaaacaccagtgcgtggttatgacgccactcgccgcggcgttggcatatttgcgctagcaaacggacttgttcggcaattgcttcgctttcaggctgccagtcaccggtattttccagccagtcagaaacctggtcatacaccagcttcgctttggattcgatggtggcggcaaagaattcgatattatcttcaatggtgccatcagtggagagcgtcatgcggcatgccagtaccgggcggacttcattggcgcgcagtgagcagagatcgtcagaaagctcgcgaggcagcatagggatgttgaagccaggcagatagttggtgaatgcgcgaattttcgcggctttgtccagcttgctgccttcagcaatccacgcggttggatcggcaatcgccacaatcagctgaagtttgccatccggtaacgccttggcgaaaagggcgtcatccatatcttctgtgctggcactgtcgatggtgacaaaatccagcgcagtcagatcttcacgaaccagaccttcatcgagcatttcggtagcgacgccgtctggtgcttctttttccaagttatgacgcgcaagggtaacccaccacggtacaaagtgatcgtcaccaaaagtgatgtattgtgtcagttcagcatagaaagaacgatcgcctttcagcggatgacggcgcatttcggcaaccgcccagtcgccttctttaaattcgtggttcaggccacgggctgcgcggcaaggaatggcgtcttttaagagtggatgatcaggaacgatggccagacggtcatttttgccctgaactttacccacgaaacgagtcaggaacggttcaaccagttcttctggctctgcggattcacgttctttttcactgtggatcaccgcgataattcggtcgccatgcatgacttttttcatctgcggcggcggaatgaaataacttttttgcgcgtcgacttccaggaagccaaagcctttttctgtggcttttaccaccccttcagcgcgtggcgtctgggaatgcagttgctgtttaagctgcgctagcagcgggttgtcctgaaacataattgtctattttggtggccattagagcggctgacagttttacgcgaatctgtctgacgcggcaaggttaatatgtctcacccaacgcgatttttaagcgatttatccagccacacagcccgctccataccagcagattaataatctgcgttgatgatttttcgtgttcgagtaatgggctgaactgggcggcgctaaagcgatcgggtgctcgggtcagccattgtatcgcctgaacggtagcgcgctcaacagaatgacggtcagcccatcggttaatttcattttcgcccttgcgcagaagggggctgatttttttatattcatttgatgaattcatacaggcggcaaaacaagcaggactgccatttatccgcgcgcataacaacgccgcaagcaggttacccggctgtgtattgacccgtgtgctgtttaacaacttttcgagaagggaaagtgaaatagggtggagagagagtgtgttggccagttggcaaagttctgcagttgaactttttgtgtgctcttcagggagtttttccacctcatagctgcttcgccagcgtaatgattcatcagcaaacagtgacgcgtcggcgtagttttgtatctccagcccgggtaaccagcgtactggatgcccgagataagcctgaaatgtcgcaattgtccgcgcctgaaagccaataaaaccaatgatttggttaatgatcacacagtcacagacagtaagaccaacgtcattcagatgctggcgcgatcggttgtcgataatagaaggcgagctagccagttggcgggcatattgcgtgatttgtgccaaccgatgattactttccctggaggaatcaggcccggggagcggcgtaagtcgcgccgaatagtagttacataaccgttggacgccgcaaacctgagcaaccgtcagggccgtcgacaagcgttcataagcggtgaaggtctgtgaacgggtcacggtaagcgggtcagggaacaactctactgcaagaacgcgcgcagggaccagccatgaaaggaagggtgccagcgtttcttcatcaaggatcacgtcgagcagaaagggatcgctgacctttgcggcttccgggaccagaggcagaacgtcatactccgcagtactggattgcgtttcatgataccagtggcttttgccggtgatgtggcgttgttccatgggcgctccttggtcgtaaaggaaatcgttatcctgacgcaaggcgggaaggggagaaagacggatcggcgataacaaatatcagaaaggtataacagagataacgggcggcagaacgccgcccaatatttaccaacagaacgattatttcagttcgagttcgttcattgcagcgatgctgaaaccgccgtcaacgtggaccacttcaccggagataccggcagagagatcggagcacaggaatgccgcggagttacccacatcttcaatagtaacggtacggcgaatcggggtaacggcttcgcaatgagccagcattttgcggaagtctttgataccggaagccgccagagtacggatcggaccagcagagatggcgttaacacgcacaccttccggacccatcgcgttcgccatatagcgcacgttcgcttccagagacgcttttgccagacccataacgttgtaattcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgagtaacggcgttaacatagtcaccatccagctgatcgccaggtgcaaaaccaatagagtgtacgaaaccgtcaaatttcggccaaactttccccagttcagcgaacatggtgtcgatgctggtatcttcggcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggacagtttgctggcaacaccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgggtggctatagttgcgctttctgtagcggagagaagctgcggtacagagcattttgcgttatctactcctgacgcctgcaagggggaggttggggaaatatcttatagaatctgactttgaaactattcgtattagctccgataggtttgatgatgaaaacagaactggcgacaacaagtcgctgtctttctgatgaattgaccccaacttaatattgtcaactatcttcacagaatctccacaatctcttcattatcagaatatgcatcatgaataagataaaaatactttccattactttggagaaacgtataattagcaaaaatgagaacgatcattctcaccaagtgataggccaggagacagaaatgaccagcaagctggagatacgccacaaacagcgtcaggatgaaatcattaacgccgcccgtcggtgttttcgtctctgtggatttcatgccgccagtatgtcgcaaattgccagcgaagctcagcttagcgtgggtcagatatatcgttacttcgccaacaaagacgccattattgaagagatggttcgccgtatcatcgattttcgtattgcccaaatggacattgacgcgcgtaccgatcacttcccggaagtccttgccttgcgtaaatccttaaatgaggacgacgacgcgctgatgctggaagtggctgcagaagccacacgcaacccgcgggttatggcaatgcttgaagaagctgacgccagaatgttcgctaacggttgtgcacatatgaaaagaatgcatccccatcttagcgacgagcacattcgttgctgcgttgaagtgtttgctaccatgatggaaggtacggtttatcgtcgtttaacaccgcaaaaaagcgatccacaacatctgcaggaaatatatcaggatattgttagtatgttgataaataaataagaacagaattaaccaatagcgggggatattaatcccccttatttcattgcgaaattcatttcgcgatgcgggttcgttataactgaatatccctgacatatcctcattaatttcaatgaggagggtatttctcaccctggagaaaataatgaagtatatagcaacatctgtagtggcaatgctgctcttatcgggttgtgataatacgcaaagtaacaattcatccccgtcagaaacagaagtcggcgttgttacgctcaaatctcaaccggtttcggtagtcagtgaattaaccggacgcaccagtgctgcgctcagtgctgaagtacgtccgcaggttgggggaattatccagaaacgcttatttaaggaaggtgatctggtcaaggctggacagcctctctaccagattgatgcggccagttatcaggctgcatggaatgaagcccgggcagcattacaacaagcacaggcactggtaaaagccgattgccagaaagcgcagcgttatgcccgactggtgaaagagaacggtgtttcacaacaggatgctgatgatgctcagtctacctgtgcacaagataaagccagtgtagaggcgaaaaaagccgcactggaaactgcgcgcattaatcttgactggaccacggtaaccgcaccgatttcggggcgtattggcatttcgtcggtaacccctggcgcactggtgaccgcgtcgcaggatacagcgttaacgactattcgtggtctggatacaatgtatgtcgacctcactcgctccagtgtcgatttattacgtctgcgtaaacagtcactggcgaccaacagtgacactatgagcgtctcacttattctggaagatggcacaacctacagcgaaaaagggcgtctggaactcaccgaagtcgcggtggatgagtctaccggttcggtgacattacgggcaattttccccaatccacaacagcagttattaccgggaatgtttgttcgcgctcgtgtcgatgaaggcgtgatggaaaacgctattctcgcgcctcaacagggcgttacgcgcgatgctaaaggcaatgcaactgcgctggtggtgaataaagacaataaagtagagcagcgaacgctcgaaacgggagaaacgtatggtgataaatggctggtgctgaacggcctgcacaacggcgaccgactgattgttgaaggttctgccaaagtcacttcagggcagaccgtcaaggctgttgaagttcaggctaatggaggcaacgcctgatgttttcgcgcttttttgttcgccgcccggtctttgcctgggttatcgccattttgattatgttggcggggattctggctattcgcacattgcccgtcgcgcaatatcctgacgttgcaccgccgaccattaaaatttcagccacttatactggtgcttctgccgaaacgctggagaacagcgtgactcaggttatcgagcaacaactcactgggcttgataatttactctatttcagctcaaccagtagctctgatggttcggtcagtattaatgtgacctttgaacaaggtaccgatccagatactgcacaggttcaggtacagaataaaattcagcaggcggagtcgcgcctacccagcgaagtgcagcaaacgggtgttacggtggagaaatcacaaagcaactttttgctgattgctgccgtgtatgacaccactgacaaagcctccagttcggatatcgccgactggctggtcagtaacgttcaggacccgctggcgcgtgttgaaggtgtggggagtctgcaagtctttggcgcggaatacgctatgcgcatctggcttgacccggccaaactggcgtcttactcgctgatgccttcagacgtgcaaagtgctattgaagcgcaaaacgtgcaggttactgccgggaaaataggggcattgccttcaccgaatactcagcaactgaccgcaacggtacgtgcgcagtctcgtttgcagacggtggatcagttcaaaaatattatcgtgaaaagccagtcagacggcgcagttgttcgtataaaagatgtggctcgcgttgagatgggcagtgaagattataccgctatcggcaaacttaacggtcacccgtctgccggggttgctgtaatgctttcgcccggtgcgaatgcgctgaatacggcgacgctggtcaaggataagattgccgaattccagcggaacatgccgcagggatacgacatcgcatacccgaaagacagcactgaatttattaaaatctccgtagaggacgtaattcagacgctgtttgaagccatcgtattggtggtttgcgtgatgtatttattcctgcaaaacctgcgtgccacactgattccggcgttagctgtccccgtcgttttgctgggcacattcggcgttcttgcgttgtttggctattcgattaataccctgacgttgtttgcaatggtgctggcgatcggcttgctggtggacgatgccattgtggtggtagagaacgtcgaacgcattatgcgtgacgaagggttacccgcgcgtgaagccacggaaaaatcaatgggcgagatttctggcgcactggttgccattgcgctggtgttgtcagccgtattcctgccgatggccttctttgggggatctacgggggtaatttatcgtcagttctccatcaccatcatctccgcaatgctgctttccgtggtggtggcattgaccttgactcccgccctgtgcggttccgtcctccagcatgttccgccacataaaaaaggctttttcggcgcatttaaccgcttttaccgccgtactgaagataaatatcagcgaggcgtaatttatgtcctgcgccgtgcagcccgaacgatggggctttatgtcgtgctgggtggtggaatggccctgatgatgtggaaactgccgggcagtttcttacccactgaagaccagggcgaaatcatggtgcagtacacgctgccggccggtgcaaccgctgcccgtacagcagaagtgaatcgccagattgttgactggttcctgattaacgagaaagcaaataccgatgtcatctttaccgttgatggtttcagttttagcggcagcggacagaacaccgggatggcgtttgtttcgttgaaaaactggtctcaacgtaaaggggcagaaaacaccgcccaggctatcgccctacgggcaaccaaagagctgggcacaattcgtgatgccacggtatttgcgatgacgccgccagccgttgatgggctggggcaaagcaatggttttacgtttgaattgttagctaacggtggaaccgatcgtgaaacactgctgcaaatgcgtaatcagttgatagaaaaagcgaatcaaagtccggagttacattctgtacgcgccaatgatttgccacaaatgccgcaattgcaggtagatattgatagtaataaagcggtgtcattagggttgagtttgaatgatgtcaccgacaccctgtccagtgcgtggggcggtacttatgtgaatgactttattgaccgtggtcgtgtgaaaaaagtctacattcagggcgacagcgaatttcgttccgcgccgtcagacttaggtaaatggtttgtgcgcggtagcgataacgccatgacaccattctctgcttttgcgaccacccgctggctgtatggaccggaaagactggtgcgctacaacggctcggcagcctatgaaattcagggcgaaaacgcgactggctttagttccggcgatgcaatgacaaaaatggaggaactggcaaacagtcttcctgcgggaacaacctgggcctggagtggtttgtcattgcaggagaaactggccagcggtcaggcattaagtctgtatgcagtttctattctggtggttttcctctgccttgcagcactgtacgaaagctggtcagtcccgttctcggtcattctggtgatccctctggggcttcttggcgcggcgctggcggcctggatgcgtgatttaaacaacgacgtttacttccaggtagcgctattaactactatcggcttgtcgtcgaaaaacgccattctgattgtggaatttgctgaagcggcggttgcagagggctattccttgagtcgtgcggcattacgcgcggcgcagactcgtttacgcccaatcatcatgacctcgctggcgtttattgcgggggtaatgccgctggcgatagcaaccggcgcaggggcgaacagccgcatcgccattggtacgggcattattggcggcacgctgaccgctacattactggccattttcttcgttcctctgttttttgtactggtgaaacgtttgtttgccggtaaaccgcgccgtcaggagtaagttatgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgactggcagcaggtgattcacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgctagcgaatggtacgggaacaactgccgaggctgacggcacggtgtccagttatacgttagatctgtttggtcgtaatcagagtttatctcgggcggcgcgggaaacctggcttgccagtgaatttacagcccagaacactcgtttaacgctgattgctgaaatcagcaccgcctggctgacactggcggccgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctgccggaacaaatgataagtctggttcctgcgggagtatcatctgatgttctgctgcgtcgcccggatatccaggaagctgaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattaccgctgttcactggcggaagtaatctggcgcagcttcgttacgcagaagcacaaaagcgtgggctcattgccacctatgaaaaaaccgttcagagcgcatttaaagatgtcgctaacgcactggcgcggcggaccacgcttgaagagcaactggatgcacagcgccagtatgttaaagctgagcaacaaacggtcgatgttggcttgcgtcgctatcaggcgggtgttggtgattacctgaccgtgttgacggcgcagcgcagcttgtggagtgcacagcaggagctgctggcactgcaactgactgattttacaaaccgaatcacgctctggcagtcgctgggcggcggcatgtcatcactcaagtaaggaataatatggctagagtctctctttcatgggcattgattcttggtcttttagccggtatcggcccgatgtgtaccgatctttatttgccggctttgccggagatgtctgagcaactggcggcaaccacgaccataacgcaattaaccctgaccgcatcactgattggtcttggcgtcggacaactgttatttggccctctgagcgacaaaatagggcgtaaacgtccgttaatcttgtcgttgttattgtttattgtttcttccattttgtgcgcgacaacgaacaatatttactggctggtggtctggcgttttattcaagggatcgcgggggcgggtggttcggtgctctctcgttctattgctcgtgacaaatatcagggagtaacgttgacccagttttttgcgctgttaatgacggtgaatggcctggcaccggtgttgtcgccagtgctgggcgggtacattgtcagcacttttgactggcgcactttattctgggtaatggctgaaattagcaccgtactgttgctgggctgcctgttatttattaatgagaccttgccagaaaataaaaggggctcatcattgctattaaccggacgaagcgtggtgcagaaccgccgttttatgcgcttttgcctgattcaaagttttatgctggccggtttgtttgcatatatcggctcttcgtcgttcgtgttgcagaaggaatttggctttagtccaatgcaatttagcctggtgtttggccttaacggcatcggacttatcattgcttcatggatcttctcgcgcctggcgcgacggattaacgcgatgacattgttgcgaggtggcctgatagcggcaattttgtgtgcattgctcacggtcttatgcgcatgggtacaattgcccattccggcactggtggcattatttttcaccatcgcattttgtagcggcatcggcactgttggcggggcagaggctatgagtgcagtagggacgcaggaatctggaacggcgtctgcgttgatggggatgagcatgtttgtcttcggcggtatagccgcgccattgtcgggaattggcggagaaacactgttaaaaatgagtctggcaattacggtgtgttatacgctggcattgctggttgctctcaccagaatcgacaatcaaaagtaatgaacacctcatcctgaggggggcctgtcaggatgaggtgcaaaacactaacggtccttacgccacgcatccgccgtcaatgcttcgccaaaatgaccggcgatcagccgtttggtgagttcatgaagcggcgatgccagcacatctgcggtgctgcctcgctcgacaacctcgccctgatgcatcaccagcacctggtcgctaatgtgcttcatcattccgatatgctgggtaacataaatatacgaaatgccctgtttttcctgtaactccagcatcagattaatcaactgcgaacgcatcgacatatccagtgaggcgagggcttcatcggcaataatgacttttgggcgcaatatcagcgcgcgcgccagacccagacgctgtttttgcccgggtgctaacatatgcggatagtaactgacgtgatccggtagcagcccaaccatacgcatcgtttcaataatctgtttgcgacgctgttccggttccaggtcggtgttcaggcgcagtggaaaatccagaatttgcgagatacgttgacggggattcaacgaggtcgaaggatcctgaaaaatcatgcgaatacgctgactgcggaaggaataatcgccaaaatgcagcggatgatcgtcaatcaataactcgccgctggtaggttctatcattcccgccagcatttttgccagcgtggatttacccgaaccattctcgccgataatcgccagtgtctggccttcacgtagcgtaaagctcaagggttttaccgcttctacggtctgacgacgaaaccagccggtccggtagcggaacgttttacttaaattgcgcacttcaagtagcgtttcgatcatctcactctttctccatgttcagtgggaaatgacaggcatagagatgatttttcgcccccgtcaaacgtggcgtcacaatgcattctcgttgtgcatacgggcaacgtggccccagacgacaaccaatcggtaactgttccagcagcgggatagcgccgggcagcgtattgaggcgacttttatgcggcatcgcgctgccgaagtctggtatcgcgcggatcagcgcctgggtataaggatggtgtggcatcgtcaccaactccttactcggcgcggtttccaccgtttgaccgcagtaaagcacgttaattttatccgcccattggctaagcatttgtaagtcatggctgataagcaaaatagtggtattgctgttttggttgagacgcgtcagcaggcgaaagatttgcgcctgggttgttggctccattgagttggtcggttcgtcagcaattagcagacgcggttgattcgccagtgcaatggctatcatcactttctgacattcaccttcggtcaactcatagggaaaactgcgcatcgcatctttgtgatctttaatccccacgcggtgcagcagttcaatggcacggcgtttgcgccagccaaaacgctgccaccaacggcctttataggtccaggcagggatgttttgcatcaactggcgacccacacgttctgaagggtcaagacacgactgcggttcctggaaaatcatcgacacgttgtgaccaaccagcttgcgccgttcgcgtgcggagagacgcagcaaatcgatatcatcaaaacgcatacggtcagcagtaacacgccagttatctttattcaccccacaaatcgctttcgcaatcaaacttttgccggaacctgattcgccaacaagaccgcggatttcaccttcggttaaggtcatacttacgcggtcgacggctttaacccactcatcaccggttttaaattcaatggtcaggttacgaatatcgagtaatggcattattccacccccgcaataattgcacgacggacaccgtcgccaaggaggttaaccaacagcacgctaatcataattgccgcacctggcagcatgacagtccatggggcgacataaatcagttccagcgcatcaccgagcatcgcgccccattcaggcgagggcagttgtgcgccgaggtcaagaaagcccagcgcggcgatatcgagaattgccatcgacaatgcgcgagtgatctcggtgaccagtccggcggtgatgttgggcatcacagcaaaccagagaatattcagcgttgatgcgccatccagacgggcggcgataacgtactctttttccagttcgtcatgcaccatgctgtaaatcgaacgtaccatacgcggcagcagcgccagccagacagcaaacatggcgtgagacaaactcggtccggcaaacgctacaacgataattgccagcagcagcgaagggatcgccagtaaggtatccagaatatggttaagcaccgctgagcgtaggccgtgggtcgccccggcgaaggtgcccagtaccaggccacagatcgtcgcggcgagcgtcaccacaaatgcgccacctacggttggcgcagctccgctcagtaaacggcttaaaacatcgcgtccgaggtcgtccgtccccaggaagaaagaaacttcgccatagcgcgaccatgacggcggcaataattgataaccgagaaattgctggtcgatgccgtaaggcgcaaaccagccgccaaaaatacacagtacagccagccccgcgcagccgtacaggccgaccatcgcagaggcgtcactataaaatttgcgccaggcggtacgcagcgtgcccggcgggcgcttttcgctgtatacgctatcgtaaggcataccattccttatgtttcagagggttagccatggcacccaaaatatcagaaatcacgttaacaataatgaccagtgagccacacaccatcactccggcggaaatggctgcgtaatcctgctggcggatggcgttaattaaccagcgccctaaacccggccagctaaaaaccatttcggtgatcatcgccagcgtcagcatggtagaaaactgtaagcccaggcgaggaataaccggaggtaacgcgttatgcagaacgtggcgacgcaaaatagtaaagcgcgacaaaccgcgggtcgccgctgcttttacataattctggtcatacacttcgatagtgctgatacgcattagccggatcacttcagttgttggcgcaaccgacagggtgatcacgggcaatatcatatggcggattgcgctcatgaccatttcatcccgccacggtgagtccgaaagccaggcatcaatcaacgcaaaaccggtaatcggtttcacttcgtagagcaaatcgaaacgcccagaaacgggcaaccaacctagcgtgagtgaacaaaacagcgtcagcagaagcgccagccagaacaccgggattgaaaagcccagtaaggcgatggcgttgatcaagttatcctgccacttatggcgcgtaatcccggcaatcattcctacggggatgccaacaatcagcgcaaaaccgaaggcgaggatgcacagttccatcgtcgccgggaagacctcttttaactgttcggcaatcggttgaccgttaatgctggaaacaccaaaatcccagtggatcaggccgttaaaccagaacacccaggcattccacagtgacgcgccttgtaacggcgcatgtggggtgaaatagctcaagctgaagccaacgaaggtcagcaggaacaaggtcacaatcaataacaaaatacggcgtaaggtgaagataatcatggctttttcacctcatcctgtttctcgcgatacaccccagcaaaggaggcgttaccaaacgggctaagtaccagacctttgatatcgtaccgataggcctgcaaacgcaatgacgacgccagcggcagaataggtaattcctgcgccagaatactttgcgcttcgtcataggcttcaatacgcgccgccagctgctgcgaagagagcgccttacgcaatacgctgtcgaatttcggatcgcaccagtgggcgaggttggtctgcgaatgaattgctgcgcagctcagtaacggacggaagaaactgtccgggtcgttactgtccgtcgcccaaccggataacgtcagatcatggctcatatccatcaaccgcgcctcctgaaaacgaccttctaccggcacaatcaccacttttacgccaacctgtgccatatccgcctgaatcagttcggcggttttcagtggactggggttccacgcctgcgaacgtgtgggcacccacagtttcagcgttaagttttccagccccaacgccttcaactgttcgcgcgattttgccggattgtattcagtaattttagcctcgttgtcataggcccacgaggctcgcggtaaaatagaggcagccgtttcagccgtaccataatagatggattgcatcaggcgctggttattaatcgccagtgccagcgcatggcggaccgccggattatttagcggcggtttggcggtgttgaatgccagataggcgacgttcatccccgggcgcagcgttaaacgcaaacgcgggtcgtcacgcaaaatggatagctgactggcagcaggccaggccagaacgtcgcactccccggtcaggagtttcgacaatcgtcctgtaccgccagagcctaaatccaccaccacttgtggcatcaacggcttaccacgccagaaatcatcatgacgttgtaagcgaatatattgcccggcgcggtattccgacaactgatacggaccggtgccgaccggttgacggtcgagttgctcctggcgatcttctttctctaacttccctgcatattctgccgacatgaccgaagcataatgggtcgccaggtgccacaaaaaagaagcatccggctgggcgagacggaactcaacggtatgattatccagcttgcggacgcttttcacgttatcggcaaattgcagactgtcgaaataggggaagttactgccgttgacgttatgccacgggttgttgcggtcaaaaatccgttggaaggtaaacaccacatcatcggcattcattttacgagtgggagtaaaccagtcggttttttgaaacggaacatcgcgacgcaggtggaagcgataggtcgcgccgttgtcgagtacttcccagctttcggcaagttccggcatcaggcgataggtatagggatcgacatccagcagtcgatcataaaactgggcggcaagggtatcgacaattaacccactgctcgctttggatgggttaaaggtgttgacttgcccgctgacgcaatagacaaaaccgctgtcgcggatatcagcatgcgggggggattcaggcgcggcgattgcctgaccactcacaagtccagcaatcaccaaaagagacgataatacctggcgcataatattaagggattttatgtaaagaggctatcttactaatatttaatgacatttgccattaccgtttgtgttcagaggtcgtaatgagggccgtgtggttggtcattgaacaggtggcgtcgccatcagttcaacattcgtacccgtgatttctttataactataactcacagaacaacttagcgaggagcatagcggtacgatcgtgagaaacccattaaagcatgctgcagtgcgtgtcatttttagccggatgcggcgcgaacgctttatccgggcaacgatactgaccgatagtctgcaattaaataattactcattaccccattgattcaaaaactctgcgatctcatcaatgcgtacgggattaatccccgcttcagcagccatttcatgttgggcttcttcactgatctcttcattgttcatcaaacgggtgagcagtaactggaagtagtgggccagtggtgtgcgttcagcgtctgcgacaggctctgcgcattcggtcgcgtactcatcggcaatatcaaaatattttagcgggatatcgtggttcattatttgcccctggggttaatgcgctaagcataaaggcggatgatagcactcgtgatccgggtcatacatatttttatagttaatggcgcggtgcattaccctcaggcaggataatgcgccgcgcattcgactattacgtttcgctcaccggcgttctgtcgccatcatacaacggcactttgcgaaagcggcggatcaaataccacaaatatgcgccgcctaacgaagcccataccatcccggttgcgcaattcgatgcggcaatgaaaattttgcaggatgcgctgagagattaatacgcagaagcagggttaacgcaataatgcctgatgcgcagcgcttatcaggcctgcaaacgacgtattgattatgtatgccggataaagcgttcacgctgcatccggcaagttgtattgcccaacttcgctaaatctggtgctttttcaacaacgcgcggaactgatgataggttaaccccagcaattcagcggcgcgcttctggttatacttcccttgttccaagctgacctgaagcagttctttttcctgctgcatctgaaactcgcgtaaatccagtggcagcgtcggaagcgaagtgttttctgaaacggcgatggcttcttcagatggacggcgtttaaagggatcaataatgatgtcatcaagcggataatcgctggtgccgtgacgatacactgaacgttccaccacgtttttcaattcacgtatatttcccggccagcgataattcagcaatgtttctctggcgtgctcggtaaaacccgggaacagaggcagcttgatttcccgacacatctggatggcaaagtgttctgccatcaacataatgtcgctttcacgctcgcgcagtggtggcagttgcacaacatcgaacgctagtcggtcgagcaggtcagcgcgaaaagtaccttcattgaccatcgctgggagatcggcattcgtcgcgcataccaaccgcacattcacctgcaatggttggctgccgccgacgcgctccagttcaccgtactcaatcacacgcaataatttttcctgcaccatcatcggtgccgtagcgagttcatcaagaaatagcgtaccgccgtcggcacgttcaaatctccctggatgacgtttttgcgcaccggtaaacgcccccgcttcgtgaccaaacagttcggaatccagcaaattttcatttaacgccgcgcagttaagggaaataaacggcccttgccaacgggaggagagataatgcaggcggctggcgatcagctctttaccggtgccgcgctcgccgatgatgagcaccggtttgtccagcggtgcgagatgcgaaacctgttccagcacttcgagaaagctgttcgcctcaccgagtaaattatctttgtattctgccatgatgaaattcgccacttgttagtgtaattcgctaattcatcctggcatgttgctgttgattcttcaatcagatctttataaatcaaaaagataaaaattggcacgcaaattgtattaacagttcagcaggacaatcctgaacgcagaaatcaagaggacaacattatgggtattttttctcgctttgccgacatcgtgaatgccaacatcaacgctctgttagagaaagcggaagatccacagaaactggtgcgtctgatgatccaggagatggaagatacattggttgaagtacgttctacttcggcgcgtgcgctggcagaaaagaaacagctgactcgccgtattgaacaagcgtcggcgcgtgaaattgaatggcaggaaaaagcggaactggcactgctgaaagatagagaagatctggcgcgtgcggcgttaattgaaaaacagaaactgaccgatctgattaagagcctggaacatgaagtgacgctggtggacgatacgctagtgcgtatgaagaaagagatcggcgagctggaaaacaaattgagcgaaacacgcgctcgccagcaggcattgatgttacgccatcaggcggcaaactcgtcgcgcgatgtgcgtcgtcagctggacagtggcaaactggatgaagcaatggctcgtttcgaatctttcgaacgtcgaattgaccagatggaagcggaagcagaaagccacagcttcggtaaacaaaaatcgctggacgatcagtttgccgaactgaaagccgatgatgcaatcagcgagcaactggcacaattaaaagccaaaatgaagcaagacaatcaataataacatccaggcggcgtccgaacgcgccgccgctcatcgtctaaggagtccttatgagcgcgctatttctggctattccgttaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatctattcttgatgcagaacatccgaactggagggatcgctaatggcgggcattaatctcaataaaaaattatggcgtattccgcagcagggcatggtccgtggcgtctgcgccgggattgccaactattttgatgtaccagtaaaactggtgcgtatcctggtggtgctgtcgattttcttcggtctggcgctgtttaccctggttgcttacatcattttgtcatttgcgcttgatccaatgccggacaacatggcctttggtgagcagctaccttccagccgcgaattgctggatgaagtcgaccgtgaactggcggcaagtgaaacgcgtttacgcgagatggaacgttatgtcacttccgatactttcacgttacgtagccgtttccgtcaactgtgaggaaagttatgaatactcgctggcaacaggccgggcaaaaggtgaagcctgggttcaaattagcaggcaagctggtacttcttaccgcactgcgctatggcccggcgggtgtggcgggctgggcgataaaatcagttgctcgccgaccgctgaaaatgttgctggctgtggcgctggaaccgctgttaagtcgggctgccaataaactggcgcagcgttataaaaggtgaggggagtttcgcaaaaatggttaaatctcaggcgtataatggatagcaattttcatccatagaaggacgcttacatgtttaaaaaaggcttacttgctctgacactggtgttttcactgcccgttttcgccgctgaacactggatcgatgttcgtgttccagagcagtatcagcaagaacacgttcagggggccatcaatattcccttgaaggaagtgaaagagcgcattgccaccgccgttccggataaaaacgacaccgttaaagtgtattgcaatgccggacgccagtcagggcaggcaaaagagatccttagcgagatgggatatacccacgttgagaacgccggtggcctgaaagacatcgcaatgccgaaggtcaaaggttaaaagaattcaccatgagcggcgcttatgcgccgttttttctgtcacaccctatttacatccccatagattatttgcgttagctcacaaatacgctttttcccaggtaaaaaaagatttcctgcgtgactaaaccccttgagctcaattgacagtttattttatgcggagtagtctctcgtttcatgggaccgctaccacggaaaggcaacatgaaacagaaaattacggattacctggacgaaatctacggtggaacatttaccgcgactcatttacagaaacttgtaacgcgtcttgagagtgcgaaacgattaattacacagcgacgtaaaaaacactgggatgaaagtgatgtcgtgttaattacctatgccgatcaatttcacagtaatgatttaaagccactacccacatttaatcagttttaccctcaatggctgcaaagaattttttcacatgttcatttattacctttttatccatggtcatctgatgatggattttcggtaattgattatcatcaggtcgccagtgaagcgggggagtggcaggatattcagcaactcggtgaatgcagccatttaatgtttgattttgtctgcaaccatatgtcggcaaaaagtgaatggtttaaaaactatttacaacagcagccaggttttgaagatttttttattgccgttgatccgaaaaccgatctcagcgccgtcactcgcccgcgtgcgttaccgttattaacgccattccagatgcgcgatcattcaatgcgccatttatggagcacctttagcgacgatcaaattgacctcaattaccgtagccctgaagtgttgctggcgatggtggatgtattgctgtgctacctggaaaagggcgcagagtatgtccgtctggatgccgttggctttatgtggaaagagccgggaacaagctgcatccatctggaaaaaacacatctgattatcaaactgttacggtcgattattgataacgtcgcgccaggcacagtgatcattaccgagaccaatgttccgcataaagacaacattgcttactttggcgaaggcgatgacgaagcgcatatggtgtaccagttctcgctgccgccgctggtgctgcatgcggtgcaaaaacagaacgttgaggcactttgtgcgtgggcgcaaaacctgacactaccttccagcaacaccacctggtttaacttccttgcctctcacgatggcatcgggcttaacccactgcgggggttgttgcccgaaaacgaaatattagcgctggtcgaggtgttacagcaggaaggggcattagtaaactggaaaaataatcccgacggtacgcgtagcccctatgaaatgaatgtcacctatatggatgcgttgagccgccgtgagtgtagcgacgaagaacggtgtgccaggtttattctcgcccatgcgattttgttaagttttcccggtgtgccagcgatatatattcaaagcattctggggtcgcgtaatgattacgcaggtgtcgaaaaacttggatataatcgcgcgattaaccgtaaaaaatactctagtaaagagataacgacagaactgaacaataaagcgacattaaggtattcgatatattataagttgtcgcatttaattacacttcgtcgcagtcataaagagtttcatccggataataatttcaccatcgatgcgattaattcatttgtaatgcgaattcaaagaagcaatgcggatggcgattgcctgacgggattgtttaatgtcagtgaaaatattcagcatataaatattactgacctgcacggtcgggatctgattagtgaagttgatatattgggtaatgaaataacactgcatccctggcaggttatgtggattaaataaaaaggaacatttcatgattaaatcaaaaatcgtgctgttatcagcactggtttcctgcgccttgatttcaggctgtaaagaagaaaataaaaataatgtatccatcgaatttatgcattcttcggtggagcaggagcgccaggccgtcatcagcaaattgattgcccgttttgaaaaagaaaacccaggtatcaccgtaaaacaagtgcccgtggaagaagacgcctataacaccaaagtcattaccctttcacgtagcggttcgctgccggaagtgatcgaaaccagccatgactacgccaaagtgatggacaaagagcagcttatcgatcgccaggcggttgccacggtcatcagcaacgtcggtgaaggcgcgttctacgatggcgtactgcggattgtgcgcaccgaagatggcagcgcctggaccggtgttcctgtcagcgcatggattggcgggatctggtatcgcaaagatgtgctggcaaaagctgggctggaggagccaaaaaactggcagcaattgctggacgttgcacagaaactgaatgacccggcgaataaaaaatacggtattgcgctgcctacagcagaaagcgtgttgacggaacagtctttctcccagtttgcgttatccaatcaggctaacgtctttaacgccgaaggcaaaattacccttgatacaccagagatgatgcaggcgctgacctattaccgcaaccttgctgccaacaccatgccaggttctaacgacatcatggaagtgaaagacgcttttatgaacggcaccgcgccgatggcgatttactccacctatatccttccggctgtgattaaagaaggcgatccgaaaaacgtcggtttcgtggtgccaaccgagaaaaattctgcggtctacggcatgttgacctcgctgaccattaccgccgggcaaaaggtcgaagagacggaagcagcagaaaaatttgtcacctttatggagcaggcggacaacattgccgactgggtgatgatgtcaccaggcgcggcgctgccggtgaacaaagcggtggtgactaccgccacctggaaagacaacgacgttattaaggcgctgggagaattgccgaatcagctaatcagcgaactgccaaatattcaggtctttggcgcagtaggggataaaaactttacccgcatgggcgatgtcacgggggctggtgtggtgagttcaatggtgcataacgtcaccgtgggtaaagccgatctccctggcacgctgcaagcgagccagaaaaagctggatgaactgatcgaactgcactaaacccaggacaggaatccgcaatgaacaggcttttttcaggtcgttccgatatgccttttgcactgctgcttctcgcgcccagcttattactgctgggcggtctggtggcgtggccgatggtgtcgaatatcgaaatcagttttttacgtctgccgctcaatcccaacatcgagtcaacctttgttggggtgagtaactatgtgcgcattctctccgatcctggtttctggcactcgctgtggatgacggtctggtataccgcgcttgtggtggcgggcagcaccgtgctcgggctggccgtggcgatgtttttcaaccgcgagttccgcctgcgcaaaaccgcgcgttcgctggtgatcctttcctacgtaacgccgtctatttcgctggtgttcgcctggaaatacatgttcaacaacggctacggcattgtgaactacctcggcgtcgatcttctgcatctctatgagcaggcaccgctgtggttcgataatccgggcagtagctttgtgctggtggtgctgttcgccatctggcgctacttcccctatgcctttatttcgtttctggcgattttgcagaccatcgacaaatcgctgtacgaagcggcagagatggatggcgctaatgcctggcaacggtttcgtatcgtcacgctgcccgcgattatgccggtcctggcgacggtggtgaccctgcgcaccatctggatgttctacatgttcgcggatgtttatctgctgacgaccaaggtcgatattctcggtgtctatctctacaaaaccgcctttgcctttaatgacttagggaaagcggcggcgatctcggtggtgcttttcatcattattttcgctgtcattctgctgaccaggaaacgggtgaacctcaatggcaacaaataaacgcacactcagtcgaatcggtttttactgcgggctggcgctgtttctcatcatcacgctgtttccattttttgtgatgctgatgacctcgttcaagagcgcaaaagaggcgatctcgctgcatcctacgctgctgccacagcagtggacgctggagcattacgtcgacatttttaatccggtgattttcccgtttgtcgactacttccgtaacagcatggtggtgtcggtggtttcatccgtggtggcggtatttctcggcattcttggggcttacgcgctttcccgcctgcgctttaaagggcggatgaccatcaacgccagcttttacacggtgtacatgttctccggcattttgctggtggtgccgctgttcaaaatcatcaccgcgcttggcatttacgacactgagatggcgctgatcattaccatggtgacgcaaactctgcctaccgccgtgtttatgctgaaaagctacttcgacaccatccccgatgaaatcgaagaagcggcaatgatggatggcctcaatcgtctgcaaattatcttccgtatcaccgtgcccctggcaatgtccgggctgatatccgtattcgtctactgctttatggtggcgtggaacgactatctgtttgcgtcgattttcctttccagcgccagcaatttcaccttaccggtgggcctgaacgcgctgttcagtacgccagattacatctggggacggatgatggcggcctcgctggtgaccgcattgccggtggtgattatgtacgcgctttctgaacgttttattaagagtggtttgaccgccggtggcgtgaagggctaaagcgaccaatttctttacaaggagttttacatgaaaaagttagtagccacagcaccgcgtgtagctgcgctggttgagtatgaagagcgggcgattttagccaatgaagtgaagatccgcgtgcgattcggcgcgccgaaacacgggacggaagtggttgatttccgcgccgccagcccgtttattaatgacgactttaatggcgaatggcagatgttcaccccgcgtccggcaaatgcgccgcgcggcattgagtttggcaagttccagcttggcaacatggtggttggcgacattatcgagtgcggcagcgaggttaccgactacgcggtgggcgacagcgtatgcggctacggcccgctttccgaaacggtcatcattaacgcggtgaataactacaagctgcgcaaaatgccgcaaggcagctcctggaaaaacgccatctgctacgacccggcgcagtttgccatgagcggcgtgcgcgatgccaatgtacgcgtaggggattttgtcgtggtggtcgggcttggcgcgatcggtcaaattgccatccaactggcaaaacgcgctggagcgtcggtggtaattggcgtcgatcctattacccgtcgttgtgatattgcccgtcgccacggtgcggatttctgtcttaaccccattggcgctgacgtaggtaaagagatcaaaacgctgaccggcaagcagggtgccgatgtgattatcgaaaccagtggctatgccgacgcgctgcaatcggcactccgcggtctggcctatggcggcaccatctcctatgtcgcgtttgccaaaccgtttgccgaaggttttaacctcggacgcgaagcccatttcaataacgccaaaattgttttctcccgtgcgtgcagcgagccgaacccggattatccgcgctggagccgtaagcgtattgaagaaacctgctgggaactgctgatgaacggttatctcaattgcgaagatttaatcgatccggtggtgacctttgccaacagcccggaaagctacatgcagtatgtcgaccagcatccggaacagagcatcaaaatgggcgtcacgttttaattcaaaggaatgaaaagaatgaaaatcggcacacagaatcaggcgttctttccggaaaacattctggagaaatttcgttatatcaaagagatgggtttcgatggttttgagattgacggcaaactgctggtcaacaatctcgaagaagtcaaagcagcaatcaaagaaaccggtttaccggtgaccaccgcctgcggtggctatgacggttggattggcgactttatcgaagagcgtcgacttaatggcttaaagcagatcgaacgcattcttgaagcgctggcagaagtgggcggtaaaggtatcgtcgttccggctgcatggggcatgtttaccttccgcttaccgccgatgacctcgccgcgtagcctggacggcgacagcaaaatggtgagtgattccctgcgcgtactggaacaggtcgccgcgcggactggaactgtggtgtatctcgaaccgttaaaccgctatcaggatcatatgatcaacaccctcgccgatgctcgtcgttacatcgtcgaaaacaatcttaaacatgtgcagattatcggcgatttctatcacatgaatatcgaagaagataacctggcgcaggcgttgcacgacaaccgcgacttgctcggtcatgtgcatattgccgataaccatcgctaccagccgggcagcggcaccctcgatttccacgcgctgtttgaacagctgcgcgccgataactatcagggctatgtggtgtatgaagggcgtatccgggcagaaaatcctgcccaggcgtaccgtgattctttggcctggttgcgtacctgctaagaggtctttgtgaaaagtgcaatgacaagctctccactgcgggtcgcgataatcggcgcaggccaggtggcggataaggttcatgcttcgtactactgcacccgcaatgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcgctggaagcgggctgccatgtgatgtgcgaaaaaccgcccgccatgacggcagaacaggcgcgggaaatgtgcgataccgcgcgcaaacagggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgcggcgatgtatgtgctgggctttccggcggtgaaaagcgtgaatgcgcatagttttcaaaagatcggcacgcaaaagagctgtggtcaatttggcgagtgggatccggcaacttatagcgtcgaagattcgctgtttggcaccattgaatttcataacggcggcattctgtggctggaaacgtcatttgcactcaacatccgcgaacagtcgattatgaacgtcagcttttgtggtgataaagccggtgcgacgctgtttccggcacatatctacaccgataacaacggtgaattaatgacgctgatgcaacgggaaatggcagacgacaaccgccatttgcgcagcatggaagcctttattaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcatacactgaacaaatatgcttcactgatggcgcaggggaacggctatcttgggcttcgcgccagccatgaagaagattacacgcgccagacgcgcggcatgtatctgacggggctgtatcatcgggcgggtaagggtgaaatcaacgaactggtgaacctgcctgatgtcgtggggatggagattgccataaatggtgagattatctcgttatcccgcgaagcatggcagcgtgagcttaactttgccagtggcgaattacgtcgcaacgttgtctggcgtaccagcaacggcactggttacaccatcgccagccgtcgctttgtttcggcagaccaactgccgctgatcgcgctggaaatcagtattaccccgctggacgccaacgcgtcagtgctgatttcaacaggcattgacgccacgcaaaccaatcacggtcgccagcatctcgacgaaacccaggtgcgggtgtttggtcagcatctgatgcaggggatctacaccacccaggatgggcgcagtgatgtggccatcagctgttgctgtaaggtgagcggtgatgtgcagcaatgctataccgccaaagagcgccgtttactgcaacatacctgcgcgcagcttcacgcaggtgagacgttgacgctgcaaaaacgggtgtggatcgactggcgggacgacagacaagccgctttagacgaatggggcagtgcgtcgcttcgtcagcttgaaatgtgcgcgcagcagagttacgaccaacttcttgcagcatcaacagaaaactggcgtcaatggtggcagaaacgtcgtatcacggtaaacggcggcgatgcgcacgatcagcaagcgttagattatgcgctttatcacctgcgcatcatgacgcctgcccacgatgagcgcagcagcattgcggcgaaaggtttaaccggcgaaggctacaaaggccacgttttctgggatacagaagtatttttgctaccgttccatctgtttagcgatccgacggttgcccgaagtttactgcgttatcgctggcacaacttgcctggcgcgcaggagaaagcgcgacgcaacggctggcagggcgctctgtttccgtgggaaagcgcgcgtagtggcgaagaagagacgccggaatttgccgccattaacattcgtaccgggttgcggcaaaaagtggcctctgcgcaggcggaacatcatctggtggccgatatcgcctgggcggttattcaatactggcggaccacgggggatgaaagtttcattgctcatgaaggcatggcgctacttctggagacagcaaagttctggattagccgcgcggtgagggttaacgaccgtctggaaattcatgatgttattgggccagacgaatataccgaacatgtcaataataacgccttcaccagctatatggcgtattacaacgtccagcaggcgctgaatatcgctcgtcagtttggctgtagcgacgacgcgtttattcatcgtgcagaaatgtacctcaaagaactgcggctgccagaaattcagcccgacggcgttttgccgcaggatgattcgtttatggctaagccgatgattaatctggcgaaatacaaagcggcggcggggaagcaaaccattctgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgttggcgcaaagttatcagttctggcgggaggggactgaaatcgatcttggtgctgatccgcatagctgtgatgacggtatccacgcagccgcaactggcgctatttggctgggggcgattcagggttttgccggggtgagcgtgcgtgacggtgaattaaatttgaatccggcgttacctgtgcagtggcaacagttgtctttccctctgttctggcagggctgcgaattacaggtcactctcgacgcgcagcgtattgcgattcggacttctgcgccagtttcacttcgtttgaacggtcagcttatttcagtcgctgaagaatctgttttctgtttgggggattttattttgcccttcaatgggaccgctaccacgtatcaggagggtgaatgaaactgcaaggggtaattttcgatctggatggagtaatcaccgataccgcgcatctgcatttccaggcgtggcagcagattgccgctgaaattggcatcagcattgatgcgcagtttaacgaatctctaaaagggatcagccgcgatgagtctctgcggcgcattctgcaacacgggggcaaagagggcgactttaactcgctggagaaggcacaactggcgtatcgcaaaaatctgctctacgtccactcactgcgcgagctgacggttaatgctgtgctgcccggcattcgcaatttgctggcagatctccgagcacagcagattccggttgggctggcttctgtctccctgaatgcgccgacgattttagcagcgctggagctgcgtgagtttttcaccttctgcgcggacgcttcccaacttaaaaactcgaaaccggccccggaaatctttctcgccgcctgtgccggactgggcgtgccgccgcaggcatgtatcggcattgaagatgcgcaggcgggcattgacgccattaacgccagcggtatgcgctcggtggggatcggcgcaggcttaaccggggcgcaattattgttgccctcaacggaatcactcacctggccgcggttatcggccttctggcaaaacgtatagcaaaggaatcaacatggctcagctttcgttacaacatattcaaaagatctacgataaccaggtgcatgtggtgaaggacttcaacctggaaattgccgataaagagttcatcgtatttgtcggcccgtcgggctgcggtaaatcgaccaccctgcgtatgattgccgggcttgaggagatcagcggcggtgatctgttgatcgacggcaaacgaatgaatgacgttccagccaaagcacgcaatatcgcgatggtgttccagaactacgcgctgtatccgcatatgacggtctacgacaacatggcgtttggcctgaagatgcaaaaaaatcgccagagaggtgattgatgagcgggtgaactgggcggcgcaaattctcggcctgcgtgagtacctgaaacgcaagccgggcgcgctttccggcgggcaacgtcagcgagtggcgcttgggcgggcgattgtgcgcgaagcgggcgtgtttttaatggatgagccgctctctaacctggatgccaagctgcgcgtgcaaatgcgcgcagagatcagcaagctgcatcagaaactgaacaccaccatgatctacgtgacccacgatcagaccgaagcgatgaccatggcgacgcggattgtcattatgaaggatgggattgttcagcaggtcggtgcgccgaaaacggtttataaccaacctgcgaatatgtttgttgccggatttattggatcaccagcgatgaattttattcgcggcacgatcgatggcgataaattcgttacggaaacgcttaaattaaccatacccgaagagaaattagcggttctgaaaacacaggaaagtttgcataagcccatcgtaatgggaatacgcccggaagatattcatccggacgcgcaagaggaaaataacatttccgccaaaattagcgtggcggaattaaccggtgcggaatttatgctctacaccacggttggggggcacgagttagtggtccgtgctggtgcgttaaatgattatcatgcaggagaaaatatcactattcattttgatatgactaaatgtcatttctttgatgcagaaacggaaatagcaatttgctaaatacagggggaaggcattctcccaggataatacaaggaacaataatgaaaaagttattactctgtaccgcactggtgatgtgtgcgggaatggcctgcgcacaggccgaggaaaagaacgactggcactttaatatcggcgcgatgtacgaaatagaaaacgtcgaaggttatggcgaagatatggatgggctggcggagccttctgtctattttaatgccgccaacgggccgtggagaatttctctggcctattatcaggaagggccggtagattatagcgcgggtaaacgtggaacgtggtttgatcgcccggagctggaggtacattatcagttcctcgaaagcgatgatttcagtttcggtctgactggtggtttccgtaattatggttatcactacgttgatgaaccgggtaaagacacggcgaatatgcagcgctggaaaattgcgccagactgggatgtgaaactgactgacgatttacgtttcaacggttggctgtcgatgtataaatttgccaacgatctgaatacgaccggttatgctgatacccgtgtcgaaacggaaacaggtctgcaatataccttcaacgaaacgcttgccttgcgagtgaactattatctcgagcgtggtttcaatatggatgatagccgcaataacggtgagttttccacgcaagaaattcgcgcctatttgccgctgacgctcggcaaccactcggtgactccgtatacgcgcattgggctggatcgctggagtaactgggactggcaggatgatattgaacgtgaaggccatgattttaaccgtgtgggtttattttacggttatgatttccagaatggtctttccgtttcgctggaatacgcgtttgagtggcaggatcacgacgaaggcgacagcgataaattccattatgcgggtgttggggtgaattactcgttctgataatgtgctaaattgccggatgcggggcgagcgccaaatccggcatacatttatttcaacgacatatgcgtagcaacggtaatattttgtggtgacggttttccggcaattagctggaataataactcgcagctttgttgacctaactcctgcgtcggaacatcgatgccgcctggtgcaggcgttaatataaacgacagcgtttcattactataacccaccaccgctaactgctgcggaatagcaatgtttttctctgccgccgcacgataaatactcattaatttcaggctgtcagtagcaaacactgcctcaggcaacggtgactggcttaataattcccgtgctgcttttaatgctgtctcatgggtataaccgccgtcaacaatccattcatcacgcactgcaatattatgcgtagccaggctttgcttataaccatttacccgatccactgaaacatgaacatcaagcggcgcatgcaggcatgcaatattcttatgcccgctttcaattaacgcatcggttagcgcaatactgtcgccataattatcggtatcgacggaataaacatggctgtattgaccttcaactttaccgatcaccaccaccgggatctcgtatttgtcgagttgtgcaaagaaggattcatcagcaggcgaacttagcataataatgcctttaatcattttctgcttaattttgctttcgcatttttgcagatcttctgccggattgtgcgacgtttgtaatatcacgtcgaaaccttcttcttccgctttggcggtgatggcatgcaaaacttcagagaaaaacggattacccgccgtagttttggtcgaacgggtagaaatcaccataatggcatcaaaacccgaagaggtcagcgcgcgggccagcttgtttggttgatactgtaattcttcaatggcccgtaacactttttcgcgcgcttccggggagatattggtttgcttattcagcacgcgtgatacggtggattttgatacgcctgcaaccctggcaatatcataaatagtaggggacataggtcaggaactccgtccgaacgtgaatgctgcacatcttatggagttcgcccgtcgatgacaacacgggtagttgataatcaatggcctggcccccacattcatattcttacgaacgatttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgctcaatattcatgccggagcacgtttgccgcttttaagtgcggtgcgtgaagagcgcctgctgggcgtaaaacgcattccccagcgtgactttggcattccgcgcttcacctatgatgaagggttggcgcagttatatggcgatcctcccgcctggccgacgcctacgcgcggcgtcagtgaaattcgcctggcgttacgttttaaatcgaacgattcgctgctgcgccactttaaggacacctccacggtgtatcttgagattgtggattatcccggcgaatggctgctcgacctgccgatgctggcacaggactattttagctggtcgcgccagatgacgggcttactcaatggtcagcgcggcgaatggtcggcgaaatggcgaatgatgtgcgaagggctggacccgctagcgcctgccgacgaaaaccggctggcagacattgccgccgcatggaccgattatctccatcactgcaaacagcaggggctgcactttattcagccaggacgctttgttttgcctggcgatatggcaggagcgcccgcgctgcaattcttcccatggccagatgtcgatgcctggggcgagtccaaactggcgcaggccgataagcacaccaatgccggaatgttgcgcgagcggtttaattattactgcgagaaagtggtgaaggggttctataagaatcattttctgcgctttgaccgccagattgtgctggtggattgcctgcaaccgctcaacagtgggccacaggcatttaatgatatgcgtctggcgctgacgcagctgatgcaaagtttccactacgggcagcgtaccctgttccggcgtttgttttcgccggttatcgataagctattgtttgctgccactaaagcggaccatgtgaccatcgatcagcacgccaatatggtttcattgctgcaacaactgattcaggatgcctggcaaaatgcggcgttcgaagggatcagtatggactgcctggggctggcgtctgttcaggcgaccaccagcggaattattgatgttaacggtgaaaaaatcccggcgctgcgcggtaatcgactcagcgatggcgcaccgctcactgtttatcctggcgaagttcccgcacgtttgccaggtcaggcgttctgggataagcaaggcttccagtttgaggcgtttcgtccgcaggtgatggatgtcgacaaaccgctaccgcatattcgtctagatgctgcgctggaatttttaataggagataaattgcgatgaccgaaccgttaaaaccacgtattgatttcgacggtccactggaggtcgatcagaatccaaagttcagggcgcagcagacctttgacgaaaatcaggcgcaaaattttgccccagccacgctcgatgaagcgcaggaagaagaggggcaagttgaagcggtaatggatgcagcgttacgtccgaaacgcagcctgtggcgcaaaatggtgatgggcgggctggctctgtttggcgcaagcgttgtcgggcagggcgtgcagtggacaatgaacgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgcgatttgttgcacagtcacggcacgggtaaaggccgtgcattctgcgaaaaactggcgcagcaggcgggtattgatcagtcacatccggcgctgcagcgctggtatgcctcaatccatgaaacgcagaacgatcgtgaagtggtcagcctgtatgctcacctggtccagccagttttagatgcccaggcgcggcgcgaaatcagccgttcggcagcggaatcaacgttaatgattgccgttagcccactggcgctggtggatatggcgtttatcgcctggcgcaatctgcgtttgattaatcgcatcgccacgctgtatggcattgaactgggatattacagccgtttgcgcctgtttaagctggtattgctgaatattgcttttgccggagccagcgaactggtgcgcgaagtggggatggactggatgtcgcaagatctcgctgcgcgtttgtctacccgggcagctcaggggattggtgctggacttctgacggcacgactggggattaaagctatggagctttgccgcccgctgccgtggattgacgatgacaaacctcgcctcggggatttccgtcgtcagcttatcggtcaggtgaaagagacgctgcaaaaaggcaaaacgcccagcgaaaaataatgcaatatcgggtgctgaccggatatctttacgccgaagtgcccgtttttccgtctttgtgtcaatgtttgttgacagaaaccttcctgctatccaaatagtgtcatatcatcatattaattgttcttttttcaggtgaaggttcccatgcgtctggaagtcttttgtgaagaccgactcggtctgacccgcgaattactcgatctactcgtgctaagaggcattgatttacgcggtattgagattgaccccattgggcgaatctacctcaattttgctgaactggagtttgagagtttcagcagtctgatggccgaaatacgccgtattgcaggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcgcaattgattaacggctttaattttttacgctggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgctgcgatcaacgattcgtatgggccgtcagttgcaaaatgtcgccgcccaggatgtcagcgccttcagtcaaattgtcgctgtcagcccgaaaatgaagcatgttgtcgaacaggcgcagaaactggcgatgctaagcgcgccactgctgattacgggtgataccggcaccggaaaagatctctttgcgtatgcctgtcatcaggcaagccccagagcgagcaaaccttacctggcactgaactgtgcgtctataccggaagatgcggtcgagagtgaactgtttggtcatgctccggaagggaagaaagggttctttgagcaggcgaacggtggttcggtgctgttggatgaaataggtgagatgtcaccacggatgcaggcgaaattactgcgtttccttaatgatggcaccttccgtcgggttggcgaagaccatgaggtgcatgtcgatgtgcgggtgatttgtgctacgcagaagaatctggtcgaactggtgcaaaaaggcgtgttccgtgaagatctctattatcgtctgaacgtgttgacgctcaatctgccgccgctacgtgactgtccgcaggacatcatgccgttaaccgagctgttcgtcgctcgctttgccgacgagcagggcgtgccgcgtccgaaactggccgctgatctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaagcgtgaatatgcctgatggtgcaacaccatcaggcatattaacttatgctttcagtacagccagagctgcttcgtaatccggctcggtggtgatttcatccaccagctggctgaaaatcacattgtcattttcatcaataaccacaacggcacgcgctgccagacctttcagtgggccatcagcaattgccacaccgtaggcttgcaggaattcagcgttacggaaagtggagagggtgataacgttgttcagaccttctgcgccgcagaaacgagactgggcgaacggcagatcggcagagatacacagcacaacggtgttgtcgatctcggttgccagttggttaaacttacgtactgatgcggcgcaaacaccggtatcaatactcgggaaaatgttcagcactttgcgtttacccgcaaactgaccgagggtgacgtcagacagatcttttgccacgagagtaaaagtctgcgctttgctacccgcctgcgggatggaattggcgactgtaaccgggttgccctggaaatgaacggtttgtgacatgattatctttcctgtttacatatagttaacgtcacacctagtttatgctaactgtcaataacacagcaaacgctatttgcgcttaatccgcagaccaccgcgacaacaaggagtaaagatgagaaccgttaaggtatttgaggaggcctggcccttacataccccgtttgtgattgctcggggaagtcgcagtgaagcgcgcgtggtggtggttgaactggaagaagagggtattaaaggcaccggcgaatgcacgccgtatccgcgttatggggaaagtgatgcctcggtaatggcgcaaattatgagcgtcgtgccgcaattagagaaagggctgacacgggaggagttgcaaaaaatcctccctgccggcgcagcacgtaatgcgctggattgtgcattgtgggatctggcggcgcgaaaacagcagcaatcgctggctgatttgatcggcataacgcttcccgagacagtcaccacggcacagacgatagtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcggatttaggcgttgcgatgcttgaacaaccgcttcctgcgcaggacgatgcggcgctggagaattttattcatccgttaccgatttgtgctgatgaaagttgtcatactcgtagcaatctgaaggcgctgaaagggcgctatgagatggttaacattaagcttgataaaaccggtggtctgacggaagcgctggcgctggcgactgaagcgcgtgcacaaggttttcgtctgatgctgggctgcatgttgtgtacctctcgtgccattagcgccgctttaccgctggtgccgcaggtcagtttcgccgatcttgacggaccgacctggctggcggtagatgtggaaccggcgcttcagttcacgacgggcgaattgcatctttaggatgccagcgcagcaagtttgccatcgcaaagagatatttttcgctggcttcgtcggaggagatggggggaaactctgcggtgatgcaatgcaagttgagatctgcacaccaactgccgaaagagccaggcgtttcataaccgacgctggttaccagaggcaattcaaacgcctgggccagccattcacctaattcgctgtgtctgggatcttcaatacaggccagcggatcgtggaatgagaccacccaggcaggttgaatgcggtgtataagctggcacagcgcctgggtttcaggttcggagccaggtttgtcacctgtcagtaaaacgacatcacgttcttcagcggtgctgttccagcgataaactgtttcaccttccttccagttcgctgccggaaagtttcggtttaaatccacaccattagcattggcccgtaaccctaactggcagccgtcaggattcacacacagcaccacatgatggcggcgcaaagaaggtgtcaaagtccgcagagcacaggagagcgtgacggtcgaagagttttcatcaccgtgagtgccagccagaatcaaaccactttcgtgactggctgcaggggccggaaaccagattaacggcgcgcccaataatgaacgtccgtaatgttctgttccgggcggaaatgcgccgcgttcggcgcgtgggcgagttacggtcatgatcgtctctggttcaggaagtattacaggcagtgttgtgcaaattttgcggattatcaaatccttttcttcaacgctatgtcatcgatcttgtatcacttttttgccggaagttgtttgtattttcattgatgtgcagatattagaattgtcgtaatgttatatacatggcgtattttattcttactggttctacacatgttaatcgcatctgattgatcagttcaccttaataagtttaataaatcgtactgcacatagtacagtacgatggtagctatataattgatttacatgaagaagggcttatcaccatcagtcccgggttgattgatgcctatattctcaccaatgtgtttctcaggtttatcgatgatatctgtgattaatgctgcgacactcttacgtgatacgatcgtacctttgaatggttcattgcgtgaggtaagctcataatcaataatatcttcatcagtcagccaggcagggcgaagaattgtatattccagtccagaagcctcaattgcatccgcagccctgcggaatggttttaggggttcaccaataactgcattattccattcgccaaattttcctggaacttcatcataaataccgagggaaagaacaaagatcagacgtttaacatcacaggctttcatcgcagcgatcactgaatttgcctgaatatctaaatcttcccccgtaaggttggcatacacaacatcctgtccctgcatggcctgcttcagtgctgcatgattcagtacatcccccataataatcttgctattagttggatagggtttgtggatttttgctggctgacgggcaaataaagtttgtttaatggtttgtttatctgccagttgattaatcacatggcgggctatctgaccgccagcaccaagaatcagtacatttttcatgaaacttttcccagattattggcagcaatatgccaggccatatcactattacggatttgaatatgtttcattacagagtttcctcaaagaacggagctaatactgaaattgcttcagccacatagactttgccatcataaagatccatatggtttgcgccttcaacaatgtgatagcgtttatcctggcttgatgctcgatcgtacaggtcgtcactcatccatttgctcccagcctggctgcccgccacaatctgtatcggctgagtcaggtacacttccgccatatggtaagcatcataggtaataatctggttaaggctgcgcaaagtagcgtaacccggtgctgttggatactgcgcgcgaggggtgtggtaatattcccaggcctgacgcagttcttcgttcggcgcatcggactccttcattggtgccagtggcatagtggcgtattctccgctgctaatatcgctggttcgggcgtttgaacccgcgtcaacgtatggtagggcatcaatagatttcacattgttttcccaaccattacggaacatcgaaccaatattgaccgcactaacagtaccgatggccttgatgcggcgatcctgaattgcagcattggctgtatatcctgcaccggcacaaattcccatcgcaccaattcgggtattgtcgacataagaaagcgttgtcaggtaatcaatcacggcactgacgtcttcagtacgaatgtatgggttttctaactgacgcgactcgccgccgctttcaccttgataagatgcgtcataagcaatagtgacaaatcccttttccgccagtttttcggcataggttccggccgtttgctctttaacgcccccacctgggtgagataccacaattgccggatactgacgggtttcatcaaattttggagggaaatagatcactgcagacaaagagatggttggattattgctgttagtgaagctgactttattattcatcattccgttcctcatggagttgtcggttcgttttaacggttggtgatatcactatagatattgatcattaagttgattagacccaaaatcatgattagacctatcatttaaatgattaatagattgtatggagatactgaatgaagcgtgaagaaatcgctgatctgatggcgtttgtcgtcgttgcagaggagcgtagcttcactcgcgcagcagcccgcctgagcatggcgcagtcagctttaagccagatagtgcgccgtatagaagaacgattgggattgcggcttctgacgcgaaccacgcgcagcgttgtacccactgaagcgggcgagcatcttttgtctgttcttggccctatgttgcatgacatagattctgccctgacatccctgagcgatctgcagaaccgcccatccgggacaatacgtattactactgtagaacatgcagcaaaaacgatattgttaccagctatgcgcacattcctgaaatcgcatcctgaaattgatattcagcttaccattgattatggtttgaccgatgtcgtttctgaacgttttgatgcaggcgtccgtctgggtggggagatggataaagatatgatcgccattcgaatcgggccagacataccaatggctattgttggctcaccggattatttttctcgtcgaagtgctccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaaggaaaaaaactgatacgtgttttggataaattcacaccagatttacccggttatcacctgtactatccacaccgtcgacatgctggctcggcattctcattatttatagataggctgaagtataaaggtgctgtttagcactacttgctgatacattaatttaattcttctcttaacgtattctcagttcctttcaacgttttggttattttttattcttcgcacaatggcgacagatgctgattatgataccgaaaacgggtttgaacgtgcgaagcccgaacgtagtgctcggagttctatgtgctttaccgcattttggagactattatttacactaaatctgatttgatatattgatacttaaaacatttgatgcttcctttgtcacttttttgatggaagttgtttgcatttctttaaggcgaaacaaataattacgcatcaattttaatgtcggttagagggaaacttatgaagcactctgtttcagtcacgtgttgtgcgctgttggtcagcagcatttctctttcgtatgctgctgaagttccgagcggcacagtactggcagagaagcaggagctggtgcgccacattaaagatgagccagcgtcgctggatcccgctaaagccgtgggcctgccggagattcaggtcattcgcgatctgtttgaaggactggtgaatcagaacgagaaaggggagattgtccccggcgttgcgactcagtggaaaagtaatgacaaccgtatctggacttttaccctgcgcgataacgcaaaatgggcggatggcacaccggtaacggcgcaagattttgtctacagctggcaacgtctggtggacccgaaaacgctttcgccatttgcatggtttgccgcgctggcgggaatcaacaacgcacaggcgattattgatggtaaagccgcgcctgaccagcttggcgtcaccgcagttgatgcccatactttgaaaatccagcttgataaaccgttgccgtggtttgtgaatttaaccgctaactttgccttattcccggtgcaaaaagccaacgtagaaagcagtaaagagtggacgaaacccggaaatctgatcggcaatggcgcatatgttcttaaagagcgcgtagtcaatgaaaaactggtcgtggtgccgaatacccattattgggataacgccaaaacggtactgcaaaaagtgaccttcctgccaattaatcaggaatccgcagccactaagcgttatctcgcgggggatattgatatcaccgaatccttcccgaaaaatatgtatcagaagctgttgaaggatattccggggcaggtttatacgccgccgcagctcgggacctattattatgcgtttaacacgcaaaaagggccgacggcagatcagcgcgttcgcctggcattaagtatgacgatagatcgccgcctgatgaccgaaaaagtgttggggacgggcgaaaagccagcgtggcattttacaccagatgttaccgcgggatttacgccggaaccttcgccgtttgaacaaatgagtcaggaagaactgaatgcgcaggcaaaaactttgttgagcgccgctggttatggtccgcaaaaaccgctgaagctgacgcttttgtataacacttcagaaaaccatcaaaaaattgcgattgctgtagcatcgatgtggaaaaagaacctgggcgtagatgttaaattgcaaaaccaggaatggaaaacctatatcgatagccgtaataccggcaattttgatgttatccgcgcctcgtgggtaggggattataatgaaccctccactttcctgacattattaacgtcaacgcattccgggaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataaccctgaagatgtggcgtacagtcggactatgtatattgtgaagcattaatgtgatgggaactggcgttacccttgtggataacgccagtgatgtctgatttagcgaccctggtccggcggtgtaatgttatccatatacagcgtctggctggggaaggcaaagtccgcgccgtgtgactgtacaatatcgataatcttcaaataaacgtcttgctgtgcggcaagccactcagcccataccgtggttttggtaaagcaataaaccataatatttaatgacgaatcagcaaactggttgaaataaaccagtaaggtttgtcgctggtcgatggccgggtgatttttcagcatctcacgtacggcttcgacaataacgcccacttttgccgcatcctcataacgtaaaccaatggtcgtggtaatgcgccggttggtcattcgtccaggattttctacgctgatcgacgaaaacagcgagttcggtacgtacaatggacgattatcaaaggtcttaattttggtaattcgccagccaatttccgttactgtaccttcgatatttctgtccggtgaacggatccagtcgccaatactgaaaggacggtcgaaatagagcataatcccggaaaagaagttactcagaatatctttaccggccataccgacagccagaccaccaataccaccaaaggtcaacaagccagaaaggctcatgccgaaatgttcgccataaagcagaacaagcaccacaataatggtgattttgataatgcgcgacatgatccgcgcactggtgatatcgcgaccttttttaatctgctgtttttcaaactgattaatcagcagaaatagcttaatcgtcagaataaccgcaatcagggacgtacagataaaatcgataacgcctggggtgataaatttgagtttatagttttctataacatagttaatgatgctaccaacagcactaataattatggtgtagattaaaaattgcaccgcatggaataaaaatccttttcttttacgatctccacggcgaaaccaaaagctcatcagaatcaatgctgcgcagctaccgaaaataatgaccagattaagcgcattatttgtaaacagttcagcgatcattgttttatcaggctcctccagataattgtcgtcatgccggaaacccctggcgggactattttaccgcgacaattcattcagatcatcaatagtcagggaaggaagtagcaacattagctaactaatcaatgcgttgattgtaaatccagctaagaggtgagattttcagagcagacaacggtgaaatgtcatggtattgttacgtttaggtaacaagaaatttgtctgcacaaggattacatcatgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaagtaaaaaataggcccgataactcgggccttgtcagttattgaagagtcgttaatcgtcttcttcgtcatccagttcaacgggtgtctgatactggtcaggtttaatgaccagcaggtcgcagcgaagatgatcaatcacctgttccgccgtgttgccaaggaatgctgctgaaataccggtgcgtccgaccgtgcccagaaccacaatccccgcctgtaagtgctccgccaaatcaggaatcacctcttcgggcagacctttttctacgtgcgtcatgttttcattaatgccgaatttctgtcgcagagctttcattgccagcaaatgttgcccacgaatggcatcgttataaacgctcgggtcaaattccggcagttcaatcgcgatattaattggcgttaccggataagcgccaaccagatgaacttcggtatggttgacttgttctgccagttcgatcgtctctttgaccagtttttcattgagcgcattatggtacggctcttcactggcgagattcaccgccaccagcgccttacccccttccggccacggctggtctttcaccatccacacggggcttgggcatttgcgtaacagatgccagtccgttggcgtaaaaatcaccgcttccagacggtcatgttggtgcgccatttttagcaccaaatcgtgcccgccgctgatcacttcctgaatgatggcttcgaaaggacggttatgccagaccactttaatttcaatgggaacgccagcattgagataatattttgcctgctcgtggatccaggctgtacgctggctgatgacgccctgacgcatagcggtacgttcgtccggagagagcagggtggtcatttcgtatgagaagtcatagatcggcaaaaaggctttaattttgccaccaatccgttgatgtaaataaacagctcgccgcaatgctggttggtcgtcctggttaggatcgataacaacgagcatgttctgatacatagccatacagggtctccttacaacaactgtcaacgcagtttgtaattaaaagattaacccatatctggtgaatgaaacagtgatgaaccttctgtcagatcaataaatcagaaaaatttaatgatatgacagaaggatagtgagttatgcggaagaatcaggcaacgttacgcgtgtgaccagcaagctgggccagcgcatcgttattttcgatagtgatgtatttacctttgactgccagcataccgcttttctggaagcgacccagcagacggctgatggtttcaaccgtcaggcccagatagttaccgatatcaccacgagtcatcgtcaggcggaattcacgaggggagaagccgcgttgggcaaaacgacgggacaggttgtagatgaatgcagccagacgttcctcggcatttttcttcgacaacagcaggatcatgtcctgatcgcctttgatttcaccgctcatcagacgcatcatctgctgacgcagattcggcattttaccagacaaatcgtccagcgtttcgaacgggatttcacataccatcgaggtttccagcgcctgcgcgaaactcgggtgatgaccgctgccgatggcatcaaatcccaccagatcgcctgctaaatggaaaccagtgatttgctcgtcgccttgctcagtgatggtataacttttaatcgtaccggagcggatggcataaagcgattttagttcatctccagccttaaacagcgtctggcctttctgaataggcttcttccgctcaatgatattatcaagctgatcaagctcatgttcgttgagtgtgaacgggatgcaaagctggctgatgctgcaatcctggcaatggatagcacaaccgccagactgaatgcgccgtataattcgcttttccgggatcataggtctgctcaagccgtaattgatatttgtcaattttaacatctttttagggagcaagtaagtctaagcaaaccttaacagcagagaattccgatattagatgtaaatatatgtctatctatttgaaaacccttaagttgttaagggtgactttacataaaagtgtgaacaagctggcacaaattgtttaatgtttacagcaaaagataaccttcgtggcgcaataaccactcttttcgctgaactccgcctgcatatccggtcatggtgccgtttcggccaataacccgatggcaaggtacgacgatgctgatgggattcgatccgtttgccgcaccaacggcacgcgccgcgccagggcggcctaattgttcagccagttggccataatgcattacctgcccgcaggggatagtgcgcagtgttttccagacttcgcgctgaaatggcgtcccccccgtggcagtgggaagcgtatcaataatgctaagattaccggcaaaatattcacgaagcttgtcgcttaaaccacctgggttggtggcagaaatgcgctcatagccatctttgcgataatggatgtccagcagctgcaccatgcgttcgctgtactcttcccattcaaccgcccgcaggcgaaattgctcatcgcaaatcacccacagtggacccagtggcgtggcaattttttcttcaagtaatctcagcatccgttctctcttaagacaaacgtgggtaaatacccggacctatcggcaagccaacaagataccacgccagcaacatcagcagccataccaccgaaaagattaatactaacaaaaagtaagtaccaggtttagcgtctggtttgtcgaagtatttaagcataaagcgattttttgatttttctgcctgaagaaatgagggcaagccatcaaattccagtcagcgaaattttaccgtaggctatccgttatttgattctgtggcgtgatagccgccagacaccactgatctcgtcactcattccccaatcccggcgagaatgtggttatttacagagctaaaaaatgaataaaaaaatagagcctgtcgacatccgccagactctacagtacacacagcagtgcatcctcgtcttaaatccggcctggggtcctggtgaccggtgacagtgttataacggttttacccatccgttgccaattttcttcagtgacagatttcacgaaaatataagttaaatcatttgtcttgtgattgcataatcatgcatcgttaatcgacgagtaaatttaccgggtgagtagcccgttcgacgcttaaacatattgccgaacgattcagctgaggcatagcccagacgatgggcaattttggtcaacgaatatccatcatcaagaagcgtcactgcagaaataacgtgcatttgctgaacccagtggcgaaatgttaatcccgtctctttaacaaataagcgcatgagtgtacggctactgacgttaattttatccgctagattatccagtgttggcagatacccttggttgtttagcaaattctcacaaagctgctgtagccgctcatcatttggccaagggagttcaagtgacattttcacccccatttttatttcctgaagtatcagtgtctcgagggctgaaaaacgtaactgttgtttatctgtggtactttgcgacggtggaagttggttaattgcaattagtaattcccttaacaggggtgaaatacccgtcatgaagcaaacttttcccagcgtttcactttccgcttctgaaaccagtacggtttttaaaagtacgttgcctgtcgcaacaaacttatgcggcatttgtgggggcagccaaagcgcgctgctggcatgcactagccagacgctttctccagcccatatacgaacgactccttcagccgggtaaagcaactgggcatagagatgtttatgccagggaactgtgcctccattcagatgttccgaatccagtccgataatgtgatgccctggtgatgctttgggttgcagtgtgattgtcatttacagtaggtattttgtcagaaatcatcaaataagccatgttaaattttaaatatgacgtatgcaagtttccggatatatacggtgtaaagagtgatgataatttctaaaaaacagcttattggggtggtagcgatcggtattcttttggctggcgttgtcttttttatctggtgggtaagcaaaggaagatttatacagacgacggatgatgcttacattggtggtaatatcaccacggtggcaagtaaagtttctggttatatttctgctatagaggtgcgcgataatcagagtgtaaaaaaaggcgatattatcctgcgtctcgatgatcgggattatcgtgcaaatgtcgccaggcttgaggcaaaaataaaaagtagcaaagccaatctcgaaagcattcaagccactattgcgatgcagcagtcgataattcaaagtgccagtgaaacatggcaggcagtaaaacatgaggagcaaaagcgcctgcgagatactgaacgttatgaaaaactcgcacaatcagcggcaatatcgcaacaaattattgataacgccaggtttgactaccagcaggtcgcagcaaaggagcgcaaagccgcgaacgatttcctggtggagaagcaacggctggcagttttatctgctcaggaagaaaacgtacgtgcaagtatcgaagaagttctggccgctttgactcaggcactactggatctggaatatacccttgttcgtgcgccgattgatggcattgtcgcaaaccgcagcgcccatacaggcagttgggtggaaggcggcacatcgttagtttcactagtaccagtcagtgagttgtgggttgatgcaaattataaagaaaaccaaatagcgggaatgaagccaggaatgaaggctgagatccgtgctgatattctcaaaggggaagtgtttcacggtcacattgaaagcctttccccagcgacaggagccagtttcagcttgattccgatagaaaatgccactggcaatttcaccaaaattgttcagcgtgtcccggtacggattgcatttgacgacgcaaaggaattaaagcaacttcttcgcccgggactgtccgtcaccgtcagtgttgatgagagatgatgtctatgcgtaaacatattgctttcgccagtatgtgtattggattatttattgctcagcttgatattcaaattgtatcgtcatccctaaatgaaataggtggtggtctgtccgcaggtaaagacgaaatggcctggcttcagaccagctatttaattgccgagattattgttattccgctctctgggtggctgtcacgggtattttccactcgttggctttttactctatccgcgggaatatttactttaatgagtatcgcttgtggacttgcatggaatattcagatcatgattttttttcgtgctttacagggagttgctggcgcatccatgatccctttagttttcacgacggcgtttatttattaccagggtaaagagttggggttggctgctgcggtagtcagtgcgctggcctcactgtcaccgacgctagggccaactctggggggctggatcactgataacctcgactggcgatggctattttatatcaatatattaccgggcatatatttagttttgagtattccttttctggttaattttgataaacctgatctctctttactgaaagttgctgattatccgagtattatcctgttggccatgacactgggatgtctggaatatacccttgaagaaggagcgcgctggggatggctggatgataatactattttgctgacatcagttctggcattggtgagttttattttatttgctgcgcgtacacttaaaatatccaatccgataatggatcttcatgcttttaaggataaaaatttcacactgggatgtttcttttctttttctggaggggttggaatattctctactgtatatttaatacctgtgtttttggggcaggttcgcggattaaatgccgaagagataggttttgccgtttgcacaacaggtattttccagttattttctgttcccttttacttctggttaagtaaaaaaataaatctgcgatggctgttgatggcggggatgggtggatttgtgttttcaatgtatctttttacccctataacccacgaatggggatggcaggagttactgtttccacaggcaattagagggatttcgcagcagtttgcgatggcccacatcgtaacattaacgctggggggaattccaaaagaacggctgaagttagcctctggtgtatttaatttaacacgtaatcttgggggcgcaattggtattgccctgtgtggctctattctcaataatcgaactaattttcatttttcgagaatgggtgaaaaaatggtttctgttccccatacggtgaatgacttcatttccagaagtgctttgttttttaatcgcagtggaagtgaccagacatcggaaatactggcttcaaccaaattattgagtcaattgatgctgagggaggcgcaaactatggcattttcggatacctttctgctaatcagtggtctgttatttatcgcatttttgttggttcctgctatgaataaatcatcctgatcggagcctgtgctgaattaaactcgggctaaactgttcgatactgctaacaggctagtataaaatgccccgcctgcgcagatactcacaggtatgaagtagagtattgtttcaatctgtgaagggaacgatgcagtaagtatgaacaattaacccgtctgaatcacgacgtgtgaaggtgcataggaggttacatgaaccttgacgacaaatcgctgtttcttgacgccatggaagatgtccagccgctgaaacgtgctacagatgtccactggcatccaacgcgtaaccaacgtgcgccgcagcgtatcgacacgctgcaacttgataatttcctcaccaccggatttctcgacatcatcccgctaagtcagccgctggagtttcggcgggaagggttgcaacatggggtgctggataagctgcgcagtggtaaatatccgcaacaggcgagcctgaatcttttgcgccagccggtggaagagtgccgcaaaatgatgttcagtttcattcaacaagccatggcggatggtttgcgtaacgtgctgattattcatggcaaaggacgggatgataaatcgcatgccaatattgtccgcagctatgtggcgcgctggctgaccgaatttggtgatgttcaggcatattgcactgcgctaccgcatcatggcggcagcggggcgtgttacgtcgcactacgtaaaacagcgcaggcgaagcaagaaaactgggagcgccacgctaagcgcagtcgttgatcacgagacgcatccgcggcttatgccgccagcacgcggttgcgtccatcatttttcgctcgatacaaagcatcatcaacgcgtttaaacagttcatcgatgctttcatttccttcgtggtgcgccacaccaatgctgacggtaaagcgtggtaagcccgaaatactcacttttgccacgcttacgcggatagtttcagccagcgaaagcgcggtatccagtggggttcttggtagcaataagacaaactcttcgcctccccaacgaaacaccaaatcgcctttgcgagcgcaactttcgagggtgcgggcgagggcgcataacacctcatcacctttagaatgcccatagagatcgttaatgtgtttaaaacgatcggtgtcgatgagcaataagctgtaatcctgagcgatggcgaggtgctgcatttggcctggctcggtaatgtgataaaactgtcgccgattcagtaatcctgtcatcgcatcatggtgggcagcatgttccagctgctcctccagccgtttttgctcagtaatatcatgcacaatacataacatgagcttgtcgccataaatttcaatcggcccggcataggtctgcacatgacgagtcgaaccatccgccagtttatgaataaaattcaaaggtttatgaccaccgggtaaatgcgagatttcatgcatgataggcatgacgcgacgcccgagcatattaatttcccaggtatgtttctggcacatcgtttcatggttataaccatagaaattgagcgcggcgaggttagcatcgacgatttggccatctcgggaggggtcaatcaacaacattggtgcagagttagtcagaaaaaagcgcgcataaaaaccttgttttttgcgctgataatttgccgagcgactggcttttaaacccagcgttgccggtgcttcgataccttcgaaaataatcaccggttctgtttctgtcagctctcgcaaaacaagccgacagcttaatgctgtttcctcttctttacgctgaacggtgaggatttcgataatatcgtgttgattttgcagatcggagaggtatttcggcagttctttttgtgaggagacggaatagggaccggttcgtagctgactaaacgtgaggtcttgcatcaacagtcgcgccgcgctgttggcataaattaactgttcctcaaagggcgaaacgatccagacaggactggtgagtaagtccagggtattgaagttgtgtgtaatcattgagatcccattatttttatcaatttttgttgctatccgatcgcaaaaaagccacgtcatatgatcagataattctgataatgatagacgctatttaacacttcacacggtttgtatacggaaaagcattttgctttttgtattcaatttagacagaattttattaatcatttcagggtaatggggtgatgagatgttgcgtaacagggccagaaggctagactacaaaataatgcgttgatgatggaggcactgtggaagcgattaagggatcggacgttaatgtcccggatgcagtatttgcctggatgctggatggtagaggcggcgttaaaccgctggaaaatacagatgtgattgatgaagcgcatccctgctggctccaccttaattatgtacaccatgatagcgcccaatggctggcgacaacaccgctgcttcccaataacgtacgtgatgcgctggcgggcgagagcacacggccccgagtcagccgtctcggggaaggcacgctgattacattgcgctgtataaacggcagcaccgatgaacgccccgatcagctggtcgccatgcgtgtatacatggatgggcgattaattgtttcgacccgacaacgcaaagtgctggcgctggacgatgtggtgagcgatctggaagagggcactggtccgaccgattgcggggggtggctggtggatgtgtgcgatgcgttgaccgatcattccagcgaatttatcgagcagctgcacgataaaattatcgacctcgaagataatcttctcgatcagcaaattccaccgcgtggattcctggctctgctgcgcaaacaattaattgtgatgcgtcgctatatggcaccgcaacgtgatgtttatgctcgtcttgccagtgaacgtatgccgtggatgagcgatgaccaacgccgtcggatgcaggatattgccgatcgccttgggcgcggtcttgacgaaatcgacgcctgtatagcacggactggcgtgatggctgatgaaatcgctcaggtgatgcaggaaaatttagctcgtcgtacctatacaatgtcgttgatggcaatggtctttttacccagtacgtttctgacagggttatttggcgtcaaccttggtgggatccctggcggtggatggcaattcggattttcaattttttgtattctgttagttgttcttattggtggtgttgctttatggttgcatcgtagtaaatggttgtaacaaaagcaatttttccggctatctgtatacaaaaacgccgtaaagtttgagcgaagtcaataaactctctacccattcagggcaatatctctcttgcaggtgaatgcaacgtcaagcgatgggcgttgcgctccatattgtcttacttccttttttgaattactgcatagcacaattgattcgtacgacgccgactttgatgagtcggcttttttttgcctgttatttatcagcgtctaccctttaagagtccacccaatgaccggagggaaatatgacgacacttatttatttgcaaattcctgtccctgaaccgattcctggcgatcctgttccagtgcccgatccgatccctcgcccgcaacccatgcctgacccaccacccgatgaagaaccgattaaattgtcgcatcgtgagcgtagatctgcgaggatacgcgcctgctgactttgcgtcgatgaccacgagaatagattgtgaccgctttttctaccctgaatgttttgtcttccgcccaactcacaaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttcgtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttacaacatgcgccgcatattatcgtggcaacgccgggccgtttgctggatcacctgcaaaaaggcactgtatcactggatgcgttgaatacgctggtgatggatgaggccgaccgcatgctggatatgggatttagcgacgccattgatgatgtcatctgttttgcgccagcatctcggcagacacttctgttttcggcaacctggccggaagccattgccgcaatcagcggaagagtgcaacgcgatcctttagcgattgaaattgactcaacagatgctctgccacctattgaacaacaattttatgagacatccagcaaaggcaaaattcctctgttgcaacggttattaagcttgcatcagccatcctcttgcgtggtgttttgcaataccaaaaaagattgccagtctgtctgcgacgcgctgaatgaagtagggcaaagtgcattgtcgttacacggcgatctggagcaacgcgatcgcgatcagaccctggtacgttttgctaacggtagcgcccgtgtactggtcgcgactgatgttgctgcgcgtggtctggatataaaatcgcttgagctggtggtgaactttgagctggcgtgggaccctgaagttcatgtacatcgaatcggtcgtacagctcgtgcaggaaatagcggtctggcgatcagtttctgtgccccggaagaagcacagcgggccaatatcatttctgacatgttgcagataaaacttaactggcaaacgctgccagcgaatagttccattgtgccgctgaaagcagaaatggcaacgttgtgtatcgatggcgggaaaaaagccaaaatgcgcccgggtgatgtattaggtgcgctgacaggagacatcgggcttgatggcgcagatattggcaaaattgccgtgcatccggcgcatgtctatgtcgcggtgcgtcaggctgttgctcataaagcatggaaacagctacagggtgggaagattaaaggaaaaacgtgccgggtgcggttattaaaataatgaaatgttgaattgcagggtgcaagagtaaacatcttcttcgggattgccggatgtgacgctggccgcgtcttatccggcctccataagagtagcccgatacgcttgcgcatcgggcgctatccgggttatttcacttcaaccacattcagccgtaactcatccaactgattttcatcttcttcaggctgccagcccgctggttgtagtgggatctcttcgcgatcaaacgccagatcacccccgttaaccacttcagaaccgtgggtaatgcctttgaaatcgaacaggttggtatcgcacagatgcgacggcaccacattctgcattgcgctgaacatcgtctcgatacgccccggataacgtttatcccagtcacgcaacatgtcagcaattacctgacgttgcaggttaggctgtgaaccgcacaggttgcacggaataatcgggaacgcttttgcatcggcaaagcgctgaatatctttctcgcggcagtaggccagcgggcgaatcacgatatgtttgccatcatcgctcatcagtttcggaggcatacctttcatcttgccaccgtagaacatatttaagaacagcgtttgcaggatatcgtcacgatggtgacccagcgcgatcttcgtcgcccccagttccgttgcggtgcgataaaggataccgcgacgaagacgagaacacagtgagcaagtggttttgccctccggaatcttctctttcacgataccgtaagtgttctcttcaacaatcttgtactcaacgcccagcgtttcaagatactcgggcagaacgtgttccgggaagcccggttgcttttgatcgaggttaacagccaccagcgaaaaattgattggcgcgctttgctgcaaattgcgcagaatctccagcatggtatagctgtctttacccccggagaggcaaaccatgatgcgatcgccttcttcaatcatattgaagtcagcaatggcttcgcccacgttacgacgcagacgtttttgtaatttgttcaggttgtattgttctttctttgtaatttgttgattttcttgcattatttcagttctctggtactaaatggggcatattgagggcaaactttgcaactacgataaccgcgcattcaacatggctacctgttcgtcgttcatgtcatcaatccacataccgtaaatttcatacaccatctgcgcagtttcatgccccatctggctggctataaatgccgggttcgctcctgccgtcaacagccagcaggcaaaagtatgtcgcgtatggtacggattacggcggcgaataccagcacgttttactgctgcattccatctcgctcccaaatagtcgtagtgaaatctgatgggaaagccttgcttagcatgctggtgttgcgctacccgtacaggatgcggtaacacaggaagaaattagaacagaaactgtggcggacattgtgcattcgttgccaggcggagaaatagaacgctacaacaagtgcagaatataatttttcgcaagtgccagaatagcgatattatgcagtgttttttagttttctatcaggggatattttgtgaaacttttcggtgaataaaataattctctgtaataaatgatgggtatggttggtggttatatttgcgcatggaaatattacattggatatgaatgtatttcaaatgaaagaaccatgacacccgaatggagttagggattcattacgtatctaatctaaagaataagaaaaatacttaattcattgtgggtggtgatgatatcttgatatgtaaaaatggttctcttaataagatgtaactagcttattacttatccatagcacaagaaatggtcctgtatctgcgttgccatgaaataagataggcctaaatgtaataaagagttgcatgacaaaattactacagttcacaataaaaaagaattaagttttttgttcaagtatttttttagtgtattgttttgaaatgttctacgctgctctaaccttcagtctgaagagggcttgaatcgtgatgtcagttcgattgacataatgttattaataatgtttacgtttgaatgtgaaatatgcttaactatgccttgattgttaatcacagggactgactatgagaaaaatactgatgtatttatgtattagcatatggattgttatatcatgcgtgcctatcatattaactagcgagtatttaacagaggcgagtataatggcattgatgtttggtcatgccaatgcactatgtattggggtttttatttctattatttatatagaatgctggaggtaaatagtgtgaacagcattagtttgatgattttatactgaactaaagggggaaagaggtaacgaaaaaagacctccaccaggtacgaatctgaggcgggcagatggaggtcgatatctacacgattaaattgataagtaaaagtcccatcagggattgatttgttcgagtctaatttaaagtaatttcaacgatttggcagaatttcttagagttaatgattttcaagttttcgattaccaggaaaaaggctgggtgctgataaaatagtcatctgcattccttaaattgtgtaagggtgaaaggataaagttcaatttaaaggcggtgcaatattagcaccatcttatatatgtaatgattgatttgcctctttattctactgttgagattattgtttccgaaaattgattattataagcgcgaaaagaaatgctacagcaaataagaggacgattgtcggcgctggggctctatcgagaaaatataataaccatacacctgatattgttattgatatcgttacggcgataagtaatgccttatgaaagcgatgcgtgatgaggacagcaatagaccctggagctattaatagtatatagacagaataatttcgactgcttttaatgtggcaaaaatggtaggcgataccatgcagagtaaaccgtaatgtaataatgatatctgtaatccgctgacttgtgcctgttgatagtcaagacaaaaattcctgaaaaaacgatacctataatggtatctttctttatgatgctattatctttcagatagccagttgcaattgcacaagacagtcctacaataaatgcaccaattcccagcggcatacctataatccaggctagaactatgccaggaaacattgcgtggttcattgcatctcctattagcgcccagccttttaataccaggaaaactgataataatgcacaggggaacgatattataatagcgattatcaatgcataattcataaatttaaattgtaatgattagaggggaaaatgtcagcacatttgcgaaatgaatcaaaaagcccgcagcaatgtgcgggcgttagtgtcagcgcacaaccagcacggagcactctgcgtgacgcactacagctgcggcgttagaaccgagcagataagtggtgatatccggtcgatgggaagcaatgatgatcatatgagcggggatcttcttcgccaattccagaatgcggtctttgggcgagccttcctcaacatggacatgcactctgtcggttggcagtttaaattttttaatgatctcttccagttgcgatttggcttccgctttcaggtcatccattgccggtaattctgcggaatacgctaaacccagagaggcatagtagggcagcgaaggtattaccgtcaggaaatgaacctctgcatcatcaatctttgcctctgcctcaacgtggctaatcacgcgttgagttaattctgaatcggaaatatcgatagggacaagaatcgttctgttcataaaacctcctgttttagtatccgcataaagtgtaacgccagatgacactttttgtgtaatgacggagttcacatttttaatttagatcaaaggaggaagaataagcagaaaaagcccgccaaaacagcgggcagggggatttagaactgataaaccagacctaaagcgacaatatcatcggtagagatgccgttggcagcgtagaaactgtcatcttcatccaacaggttgattttatagtcaacataggtggacatgtttttattgaaatagtaagtcgcgccaacatcggcgtatttaaccagatctttatcatcaacacctgctgggttgtctgcaccaccggcagcgtgcaggtcacggcctttagacatcaggaaagagactgccggacgcagaccaaaatcaaactggtactgtgcagtgacttcaaagttctgggttttgtttgcaacagcataatcgctgtcgccaaacggggtcatattacgcgtttctgaatacatggttgccaggtaaatattgttagcatcgtattttagcccagcagtccacgcgtctgctttatcaccacccgccgcagtatggttaacctggtcattggtgcggtcagaagaggtgtatgccgcaccagcgctaaagcccatgcctaaatcatatgttgtggaaagaccccagccgtcaccgttttcatggcgaacatcacgtccgttgttggtgccttcctgaccattactggcaccttcgttgttaccttgatactgcaccgcgaagttcagaccatttaccagaccgaagaaatcagtattacgataagtcgcgacgccattggcacgaccagtcataaagttgtctgcattggtataagagtcaccgccaaattcaggtagcatatcagtccagccttcgatgtcgtacattacgccataattacgtccgtaatcgaaagaaccgtaatctgcaaatttcagtccggcaaatgccagacgggtccatgactggtttgttgaagattcggtgttgtttgcctgaatattgtattcccattgaccgtagccagtgagttgatcgttaatttgggtttcgcctttaaaacccagacgagcatagctctggtcgccatctttcgctgaattatcagaaaaataatgcaggccatcaactttgccatacagatctaatttgttgccgtctttattataaacttcggctgcatgtgcagcacctgcagcgagcagggcaggaattaagagtgccagtactttgcttttcattgaataaatcctttagttattttatttgcctttcatccccattttggggagtgaaaacatcctaaaggagaagttcagttagccgataaatatcatttgttacgccttaagtaaaaccttaattaaataattcttcagaaatgataataagtctggtgaatgtattggagataacacatacaaaataaaaattatacttttaattttctatacgttattctgcgcgggttatatgcctttattgtcacagattttattttctgttgggccattgcattgctactgattttccaacacataagaagacaagcccgaacagtcgtccgggcttttttttagaattggataatccttatccagagcatttaatcggtgttgcttttttccgcttttccggccatttgtgccaggaagtcatagcgtttttgcaaatcagctgcagcatctttccataactgttctgccacttctggctgctgcgaattcagacgacggaaacgctgctcgtgaagtaacgtttcttccagtgcttctgacggcgggcgtgaatccagcgccagcggcagtttgccttcatcggcacgacgaggatcgaagcgatataacggccagaagccggtagcagtgagttggcgcatctgatcgtggctgagtgccagatcgtaaccatgctcttcacacgggctataagcgatgatcagcgatggccccggatacgcttccgcttcctgaatcgctttcaccgtctggttcagctgcgcgccgagagaaatctgcgccacataaacatgaccgtacatcatcatactgacgccaagatctttacgcgctttacgtttgccatgctcgccaaacttagttactgcacccagcggtgtcgctttcgatgcctgaccaccggtgttggaatagcattgcgtatccagcaccagaatgttgacgttttccgtcaaactcaatacatgatccagaccgccaaagccgatatcgtaagcccagccatcgccaccaatcagccagattgatttttccaccagtgcatctgcgtcacgcagcagttcatgtgcttcggcaacatcgttgagttgctggcgtaaagctgcaacctgttcacgacgaacctctggcgtggcgtctgatttcaacgcagtcagtaattccgtcgggattttatcggcaaattgattgagcaaacgcagcacgcggacacggtgttgatcgaccgtcaggcggaaaccaaggccaaattcggcgttatcttcaaacagcgagttcgcccatgccggtccacgaccgttggcatcggtggtatatggtgttgaaggcaggttaccgccgtatattgaagaacagccagtggcattagcgatcaacatccggtcgccatagagctgagtcagcaatttaatatacggcgtctcgccacaaccggagcaagcacctgaatattcaaacagcggtgtaatcagctgcgatgtacgaatatcaatacgttccagtttgctacggtcgatttctggcaggttgaggaagaaatcgtaattgattttctcttcttcgacatgttccaggcgcgacatcatattgatggctttaatctctggattctgacggtctttcgccgggcaaacttcgacgcacaggttacaaccggtgcaatcttccggagccacctgcaagacatatttctgcccgcgcatatcacgcgatttcacatccagcgaatgcaggctggcaggggcgttttccatcgcttcaggcggtaccacttttgcgcgaatagctgagtgtgggcaagcggcgacacagtggttacattgggtacagagttcctctttccagatggggatctcttcggcgatattgcgtttttcccagcgcgtggtgcccatcggccaggtgccgtctggcggcagcgccgaaacggggagggcgtcgccaagcccggcgagcatcgcagcggttacggttttcacgaaatcaggagcggcatcggaaaccaccggcggtcgattggcgctatgcggattaactggctgcagtggaacttcttctacggattcacgtgccagcgccagagcctgccagttgcgttccaccagatcctggcctttgctactgtaacttttggcaatcgcaccctgcaattctgcgagggcactatcgccaggcagaatttgcgtcagatggaaaaaagccatctgcatgacggtattaatacgggccgccaggccacattcacgggcgattttcgccgcgttaatcacatagaagcgcgcttttttctggtttagcacggcctgaacttcctgcggcaagcgcgaccacacttcagctgcgctgtacggcgtgttgagcaggaaaatgccgccaggttttaaacgctcagccatctgatatttatcgataaactgcaactggtggcagccaacaaaatcagcctgggaaatgagataagcggaacgaatcggctgttcgctcacgcgaaggtgagaaaccgtcaggccgcccgcctttttggagtcgtaaacaaaatagccctgtgcgtaccacggcgtggaatttccgataatcttgatattgtttttggtcgcggaaacgctgccatcactaccaaggccataaaacaaggcttccagtttcgccgagtttggtagggtgttttccggcaacggcagtgacagattggttacatcatcgtaaataccaaccgtaaagcgcgctttcggtttagccgcgttgagctcggcaaataccgccagtacacagtccgggccaaattctttggatgaaagaccatagcgcccaccaatgacacggggcagggtttcgcgctcgccattattaaaggcttctgccagtgcggtcatcacatccaggtacaggggttccgcttgcgcacctggctctttggtgcgatccagcaccgccactgtccgaacagagtccggcaacgcttgcagtaagtgtttggcggagaaggggcggtacaggcgaactttcagcacgccgactttttcgccacgggtcagcaattcatcaaccacttcttcacatgtgccaatggcagagcccatcaggataatcacccgttccgcttgcggatgcccgtaatactcaaacggctgatactgacgacctgtcgcggcagcgaaatcattcatcgcctgttcaacatggtcatagaccgcgttgtaccatgggttggtggcttcgcgagactggaaataagtgtcaggattggcggacgtaccgcggatcaccggatgttccgggttgagtgcccgggcgcgatgagcatcaatttctgcctgcggcatcagttcaagaatcgtgtcatcggccagcgggacaattttattgatttcgtgggatgtgcggaaaccatcaaagaaatgaataaatggcacgcggcttttcagcgtcgcgatgtgcgaaatgagagcaaagtcttgcgcttcctggacgtttgctgcacacaacatcgcgcaacccgtctggcgcaccgccataacgtcggaatgatcgccaaaaatagagagtgcatgtgtggcaacggtacgtgccgcaacatgcaggacaaacggtgtgagttcgcctgccagtttgtacagcgtcgggatcatcagcagcaaaccctgcgatgacgtaaacgatgttgagagggcaccagtttgcaaagcaccatgcacggtagcgatagcacccgcttccgactgcatttcaaccacgcgtggtgtgtctccccaaacgtttttcaagccgtttccggcccatgcatcagcctgttctgccatcgtggaactgggggtaatagggtagatggcgataacttcactggtgcgaaacgccaccgaagcaaccgcgccattaccgtcaatagtaatcatatgacacccttacattgcgcaaatgaggggcgcacgaaattgctgcgcgcccagtagtaatcgttcaattttagcaaatggctttcttctgcattttcgcttttgtgtcccccacatcagcgtaatgaatgttttgatcaaacagagggcaaaaaaatagccataaaaaagtaaaaatgcggggcaacgcgcaggacagctctcgacgccgccctctgtgctgcctattatttatggcggtgtcgtttggcttgaagatcagaggaagaaaagatgcgagcagcgttttgggtagggtgtgccgctttattgttgtcggcgtgtagtagtgaacctgttcagcaggcgactgcggcgcacgtagcgccaggtttaaaagcgtcgatgtccagtagtggagaagcaaattgtgcaatgatcggcggttcgctttctgttgcccgccaactggatggtacggcgattgggatgtgtgcattacccaacggcaaacgctgtagcgaacagtcacttgccgccgggagctgtggcagctattaattcattaaatccgccagcttataagttaatgtctgtttcgcggtcgccagcgttaactggttcgcggtcagatccacttgtgcaccttctttcagcatttcgctaatggtgttatcgagttcattaagctgcgggttagcgcacatcatacgggtcattgccagccctttggcggtcagttcaccattagacagtttgccttcaccgctaaagcggttacacatgctgccggaaatcatcatcttttcaccaaagctgatttctggcggatttttatcgctggtcacgggcttaccgtttacgctttccagcacaaagcgatgatgctgtagctgttctggcgttacagcaattttgtcactacttacacatcccgccatcagcaggcttagcgcaacaagcgcggctactttcttcattgtggttctcaattactgtttctgattcaggactattttaagaatagaggatgaaaggtctttggggattatctgaataagctcccctggaatgcaggggagcgggaagattaaaccagttcgttcgggcaggtttcgcctttttccagattgcttaagttttgcagcgtagtctgagaaatactggtcagagcttctgctgtcaggaatgcctggtgcccggtaaacaacacgttgtggcaggcagacaagcgacggaatacgtcatcctggatcacgtcgttggatttatcttcaaagaacagatcgcgttcgttctcatacacgtccatacccaacgaaccaattttctgatttttcagcgcttcaattgccgcctgagaatcaatcaatgcaccgcgactggtattgacgatcatcacgccatttttcatctgatcgaaggcggcttcgttcaacagatggtagttttccggtgtcagcgggcagtgcagagagataacgtctgattcagagaacagggttggcagatcgacatactccacaccgagttccagcgccgccgcacttggatacggatcgaacgccagcagacgcataccaaaacctttcagaatgtgcagcatcgccacaccgattttaccggtaccgataacgcctgccgttttgccatacatagtaaagccggtcagaccttccagagagaagttagcgtcacgggtacgctgatacgcgcggtgaatacggcggttcagcgtcatcatcataccgatggcgtgttcagcaacggcctctggatcataggctggaacacggactactttgagccccagttcttttgccgcgtcaaggtcgacgttattgaaaccggcacagcgcagggcgatatatttaacgccgtgctttttcagctcttccagcaccgggcggctgccgtcatcgtttacgaaaatacataccgcttcgcagccattggcagttttagcggttttttccgtcagcagaaagtcaaaaaattccagctcaaagccaaaggactcgttcacctgttgcaggtacttcttgtcgtactgttttgtgctataaacggcgagtttcataagactttctccagtgatgttgaatcacatttaagctactaaaaatattttacaaaatttcaaatataattgaaagatatggcgatattgaaaaattcatcaacaactatgcttagtgtaggcgcaaccttcaactgaacggttaaacatgccacaatacccgtattgaatgcttaatttttcgctaaatcaggatattaactacccatgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcatccccgatctccgttatctggtgggagattgtcagcttgcgcatatcaccaacgccagcctttcacatcccagccgctggttattgaacgtcggcacggtagaacttgattctgcttgtctggcgaaattgccgcaggcggaacaatcgccagccgctccaaaaaccctcgcgcagtggcagtccatgctgcctaacacctggatcaatatcgataaactgattttttctccctggcaggaatggcagggaaaactctctctcgcattaacctccgatatccagcaactgcgttatcagggcgaaaaagttaaatttcaaggccagctgaaagggcaacaacttacagtcagcgaactggatgtcgccgcgtttgaaaatcagccgccggtaaaactggtgggggaatttactatgccgctcgtgccggatggacttccggtaagtggtcatgttactgcgacgttaaacttgccgcaggaaccgtcactggtggatgtcgagctggactggcaggaaaatagcgggcaattgattgtgctggcacgggataacggcgatccgttgctcgatttgccgtggcaaattactcgtcaacaattgaccgtaagcgatggtcgctggagctggccgtatgcaggttttcctttaagtggccgactgggtgtcaaagtcgacaactggcaggcagggctcgagaacgctctggtcagcgggcgactgagtgtgctgacccagggacaagcgggtaaaggcaacgcggtgttaaattttggcccaggaaaattaagcatggataacagccagctgtctctgcagctgaccggtgaagcgaaacaggcggacctcattttatatgcccgtttacctgcgcagctaagcggaagtctgtctgacccaacgctgacctttgagccaggcgcgttattacgttcgaagggaagagtcattgattcgctggacatcgatgaaatccgctggcctttagcgggtgtaaaagtcacccaacgtggtgttgacggacgtttgcaggccattttgcaggcgcatgaaaatgaactgggcgatttcgtgctacatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccgtcgtctggggacgtgacgcacagcatccctcattcagcggcgcgctgtcactggacgccgggcaaacgctgttcactggcggcagtgtgttaccgccatcaaccttaaaatttagtgtcgatgggcgtgatccgacgtatttcctctttaaaggcgatttacatgctggtgagattggcccggttcgggtaaatggtcgctgggacggtattcgtctgcgcggtaacgcctggtggcctaaacaatcactgactgtattccagccgctggtgccacccgactggaagatgaacttacgcgatggtgaactgtatgctcaggttgcattttcagctgcgcctgaacaaggattccgcgcgggagggcacggcgtgttgaagggtggtagtgcctggatgccagataatcaggttaacggtgtcgattttgtcctgcctttccgttttgccgatggagcctggcatctggggactcgcggtcccgttacgttgcgaattgccgaagtgattaatctggtgacagcgaaaaatattacggctgatttgcaaggtcgttatccgtggactgaagaagaaccattgctgttgactgatgttagcgttgatgtgttaggcggtaacgtgctgatgaaacaattacgtatgccgcaacatgacccggcgctgttgcggctgaataatctttcctccagcgaactggttagcgccgtcaatccgaaacaattcgccatgtccggggcatttagtggtgcattgccgttatggctaaacaacgaaaaatggatagtgaaagacggctggctggcaaatagcgggccaatgaccttgcggctggataaagacaccgcagatgcggtggtgaaagacaatatgaccgcgggttcagcaattaactggttgcgctatatggaaattagccgttcatcgacaaaaattaatttagataatctcggtttattaaccatgcaggccaatattacaggtaccagtcgcgttgatggtaaaagtggtacggtaaatcttaattaccatcatgaagagaatatttttacgctgtggcgcagtttacgctttggcgataatctccaggcatggctggagcagaacgcgcgtctgccgggaaatgactgtccgcaaggaaaagagtgtgaggataaacaatgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgagacccgtagcgatcttttttgaggtgatgatgaaaagaacattacttctttgtgcatttcttgttggcttggtaagcagcaatgtaatggcattgactctggatgaagccagaactcaggggcgggtaggggaaacattttatggttatctggttgcgctgaaaacagatgctgaaactgagaaattagtaaccgacatcaatgccgaacgtaaagcgagctatcaacaactggcaaagcagaataatgtgtcggtggatgatatcgcgaaactcgccgggcaaaagctcgtagaacgggccaaacccggggaatatgtacaagggataaacggtaaatggatgcgaaaattttaatagcaaaaccgcaatatcgggataacgctacaggagaaggcgattaatctattttccggaaacattttgctcttttaattataaggctgagttatatttcggctctgctttatttattcgagtattggtttataccgtttttttcattaaataaatatctatgtgacgcatttgaatttataatttatataatatagataatttgtatgtttcgcaggtttatttatttctctgtattataaatccagattgtcagaaaatatgtttgattaggtaacaatctactggcaatattggacgtcctctatgttttaaataatcaattggtcgggtcagggtatccgaccttctttatattcgccagaaggatttattatgcaaaggaaaactctattgtcggcctgtattgcattagctctgagtggtcagggttgggcggcagatattacagaaatagaaaccaccacaggtgaaaagaaaaataccaatgtgacttgtccagcagatcctggaaaactcagtccagaagagcttaaacgcttaccctctgaatgctcctctgtagtcgaacagaacctgatgccatggcttgtcacaggtgctgctactgcgttaatcacaaccttagccatagtggaactaaacgacgatgatgatcatcatcgcaataattctccacttccaccaactccacctgatgatgattcagacgacactccagttcctccaactcctggcggagatgagataataccggacgacggtccggatgatactcctgcacctcccaaaccgattgcgtttaataatgacgttaccctggataaaacagcaaaaacgttaactattcgcgattcagttttcagttataccgagaatgctgatgggactatttctctgcaagatagcaatgggcgtaaggcgactattaatctttggcagattgatgaaacgaataacacggttgcccttgaagggatgagcgcagatggtgcaacgaagtggcaatataatcacaacggtgagctcgttattacgggcgacaataccacagtaaacaacactggaaaaaccatcgtcgacggcaaaggcgccaccgggactgaaatcgcgggtaataacgcggtggtgaaccaggacggcgagctggatgtgagcggcggcggtcacggtattgatatcaccggcgacagcgcaacggtggacaacaaaggcggcatgactgtcaccgatcctgactccatcggtattcagatcgacggcgacaaggcggttgtcaataacgacggtgacaatgccatcagcaacggcggcaccggcacgcaggttaacggcgacgaagccaccgtgaacaataacggcaacaccaccgttgacggcaaggattccacgggcaccgagatcgcaggtaataacgccaccgttactcaggaaggtgaactcacggttagcagcggcggtcgcggtatcgacatcacaggcaacaatgccaaggtcgacactaaaggcaaaatgaccatcacaggtactgactcggttggtgtgtccatcaatggcgacagtgcgacgttgaccaatacgggcgatattgacgtcagcaattcggctaccggattcagcctcgtaaccaatgaggggattatctcgctggctggcagcatgaaagtgggcgatttttcaacgggcatggcgcttagcggcgacaacaacagcgtgacgctggcggcgaaagatatcaatgtcaccgggcagaaagcgacaggcgttaacatctcaggcgatagtaataccgttgatatcaccggtaatattctggtggataaagaccaaaccgcagataacgcggtagattatttctacgacccatccgttggtgtgaatatcagcggcaacagtaacacggtatcactggacggtaagctgaccgttattgcagatagtgagttaacctcacgcaaatacatggagtttgatggtagccaggagaatatttctgggcttaccgtgtctggcgatggtaacaccgtcaatttgaatggcggcattcagtttgtgggcgagaaaaacgcgctggcagacggttcaactattgccgataagcgcagctactttggtaagacacctcttgttagtgtcgatggacaatccaaagtttatctgaacggtgattctactatcagcggctctttgccgttaggctatgccaacattcttcagctaagcaataaggcggcgcttgaaattggtagtgacgctacgttcagtatgcaggacattagtgtttacgagcactatttcacgcaaactccgcaaattatcaaggttgatacgggttcacaggtcgtcaacaatggtgatgtggatatctggaatatcagttttgcaggcatttggggcgaaaactctaccggtattaacaacggaaatattacgctttctcaatatgactattcttctccggagacatcgttctcagaacctgaccacatggcctttttaagctccagtggcggtagtgctgtgaacaacggaacgatcactgcaaaagtgatggaacagcacagtgttctcaatatgggctctgcagccggtgttgcagacccgagggtattcaataatagcgtgtcgagtatgatgggaatggaggcctacggtaaaggcactgttcttaacagcgaaagcggcgttattgacatgcacgggcgcggcaacattggtatgttggcagttgatgactccgcagcggataacgccgggaaaatcacgctggatacgctttgggtcgatcaaaacgacaccacgacgctgcgtactgacctcccttccagcacggctatagattacggtgttggtatggccaccggaacgaatagtggtggtggcgcaagaagcaacggtgttgcgactaaccaacaaggcggtgtaatcactgtttataatgccggtgctgctatggctgcttacggtgccagcaacatggttattaaccagggcattatcaatctggagaaaaacggaaattacgatggcggcttgggcgcgaatatgctcgtggggatggcggtctataacagaggcaccgctatcaacgataaaacaggcgtgatcaatattaacgtcgatacggggcaggcgttttataacgacggtacagggacaattctgaactatggtgagataaaccttctcggctcgccaatggacagtgcagactctcacatgggggctattccggaaaatctggatctgctgacagcactgacaggcagcggcgaaacggatatgcgaactgcttcaagtggcgggtttgtgacgaccaaagcgctggcaaactacggcaatgaaacgctgaatagcaatgtggctgccaaagcgtggctttataaccaggataaggccaacctgacaattaacggagagctatccatcgggcaagggctggaaaacagcggcttactcgattctgacaccattagcgcagccgcgaatgtctataaccgagcatcgggtagcattatcactgatcagttatcgctaacgggtagtaactcgtttttcaatgagggcaacttcagcggttcggttgctggctctagctataagcaaaatgtggttaacacgggaacgatggctgtaatggccgacggtaagtcgcttatcagtggcagcttcctgctttataacgaagcaggcgcaacactcagcaacagcagcagcgccgtttcaggtggagaaaatgccattgttaacgtaacccgcaccggcgattcactcgcgcaagttaaccgtggcaccattactgcgatcaacggctacagtgcaattaaaacggcaagtacgggttctaacagcaacgggaaatggatctggaataccgacacgggggtaattagcggcgtgaatccaaatgcaccgttaattgatcttggtcgcggctataactttgccaacgccggcactattaatgtgcagggtgatggtgcagtcgctatcagcgggggaaccaccagctatacggttcaactggtgaacagtgggaccatcaatgtcggtacggcgcagggtaaagcggacggcactaacggtactgggttaattggtatcaaggggaatggcagtgatacgacaattaataacgcacaaagcggtgtaattaacgtttatgcagataattcctgggccttcggtggaaagaccaaagcgatcattaacaatggtgaaattaacctgctgtgtgatacgggatgtgatatctatgcaccgggtaccaccggtacgctgaacgatcataacagtactactgatattatcgttcctgcagcaacgagcacacctacgcagggttcagtccccacagtacctgcggactccagtgcacagcaaaaactgactaactacactattggtaccaatagcgatggcacctctggtatgttgaaagccaataacctggtcatcagcgacaacgtcaaggtaaataccgggttcagtgcaggtactgccgatacgactgttgtgattaatgatgttttcaaaggtgaaaatatttccggggctgagaatatttcttcttccacggtaatgtggaatgctcagggcagcactgatgccagcggcaacgtagacgtcacgatgaccaaaaacgcctatacggatgttgtgacggattcttcagttaataatgtcgctcaggtactggattcgggttacaccaataacgacctgtacactagtctgaacgtaggaacgactgctgaactgaacagtgcgctgaaacaaattagcggcagccaggcaaccacggtattcaatgaagcacgagtgttaagtaaccgcttcagcatgctgtccgatgcagcaccggaagttgcaaacggtctggccttcaacgtggtagcgaaaggcgacccgcgtgctgaactgggtaacgacacacagtacgacatgatggcgctgcgtaaatctctgacgctgactgaacatcagaacctgagtctggaatacgggattgctcgtctggagggtaatggttcagataccgcaggcgataatggtgtgacaggcggttacagccagttcttcggtctgaaacaccagatggcgtttgacaacggtatgagctggaataacgccctgcgttatgatgtgcataatctcgatagcagtcgctcgatagcttacggcgacgtcaacaaaaccgctgatgctaatgtgaaacagcagtatctggaattccgtagtgaaggggcaaaaacctttgaactgcgtgaaggtctgaatgtgacgccttatgcgggtgtgaaactgcgtcatacgctggaaaacggttatcaggagcgtaatgcgggcgactttaacctgagcatgaacagcggcagcgaaacggcggtggacagcatcgttgggctgaaactggactatgcagggaaagaaggctggagtgcgaacgccacgctggaaggtgggccgaatctgagctatgtgaaaagtcaacgtactgcgagtatttcgggcgcgggaagccagcgtttcaacattgacgatggtcagagtggcggtggtttcaacagcctggcgacgatgggtgtgaaatacagtagccaggagagtgcattgcagttagatgccttccactggaaagaagacggcatcagtgataaaggtgtgatgctaaacttcaagaaaacattctaatttttagcatgtaatacataaaccgcaacgctgatacaggttgcggtttttttattgccggatgcggtgcttgacgcgttttgttttggtgtctttcaggatattagagctactcatccagtaatcttgtttacgccttcgcattatttatctctattcatttctatactgatttttcttaatccgttttattacagggcagggtacgatgagcagcaacacatttactctcggtacaaaatccgttaaccgtcttggttatggcgcgatgcaactggctggtcctggggtttttggcccgcccagagatcgccacgtcgctataaccgtgctgcgcgaggcgctggcattgggcgtcaatcatattgataccagcgacttttatggtccgcacgtcaccaatcagattatccgcgaagcgctttatccgtactctgacgacctgacaattgtcactaaaattggtgcgcggcgtggagaggacgcttcctggttacccgcattttctccggcagagctgcaaaaagcggtacacgataatctacgtaatctcggcctggacgtactggatgtggttaacctgcgcgttatgatgggggatggtcatggcccgacggaaggatcgattgaagccagcctgacagtgctggcggagatgcaacaacaaggcctggtaaaacatattggcctgagtaacgtcacaccgacgcaggttgcagaggcgcgaaagattgccgaaatcgtctgcgtgcagaacgaatacaacattgtccatcgagctgatgacgcaatgattgatgctttggctcgtgatggcattgcctacgtgccgttcttcccgctcgggggctttacgccgctgcaatcctccacgctttccgatgttgctacaagccttaatgcgacaccaatgcaggtggcgctggcgtggctgttacaacgttcaccgaatattttgttgattcctggaacatcttctgttgcgcatttacgggagaatatggctgctgaaaaattgcatctttctgagaaagtgttgtctacgttggatggtatttcgcgagaataacgaatatacaaaagggaaagatgcatttcccttttgtttcttttttaatggcatggagtgcatatgtttaaggccaggatttgcggctggataatcagtgaaaaggcgatggattcattgattcgtacagtgatagatggtatctcactgatatccagacggtaatcaaacagatgtgtagggcattcatccaccacatcttgatatattccgaatttacgttgatgctgcgcgttgtgatatctccgccgtcggaattgatgcaccatagagcaaactgaatatcacggaatgataaatgacgctctaccagataaaaccgctctttcagtcgctgttaaggccgacgatgttttggctttataagcaccatgttacagcgaatcacatcactcttgctgcactggcgctttctcttcttaccggattgctgttggtgttggtggcacaacccatcctctttttgctattgcccatcgtgctttttatccgtatgacgctcaatgcgctggatggcatgttggcgcgtgagtgcaatcagaaaacacgtctgggggcgattttgaatgaaactggcgatgttatttccgatattgcgctctatttaccgtttttatttttaccggaaagtaacgcatcactcgtaatactcatgttattttgcaccatattgactgagttttgcggtttactcgcgcagacgattaacggtattcgcagttatgccggtccatttggcaaaagcgatcgcgcgttaatatttggtctgtgggggctagccgttgccatttatccacagtggatgcaatggaataatcttttatggagcattgcttcaattctgcttctctggactgcgattaatcgttgtcggagtgtgctttttatgagtgcagaaagataatgctggaaaaatctctggcaacacttttcgcgttgttaattttagcaacgctgataaaccgttttctggtatggcggttaccggagagaaaagggggtgaggttacattacgtattcgtacctggtggggcatcgtcatttgtttttcaatggtgatttcaggtccacgctggatgacgttgacgttttttgcgctgataagttttctggcattgaaagaatattgtacgcttatatctgtacattttccgcgttggttatattggggtattcctcttaactatttgcttatcggttttaattgctttgagctgtttctgttatttatacctttggctgggtttctgatattagccacctggcgagttttagtgggtgacccctccggttttctgcataccgtgagcgccattttttgtggctggataatgaccgttttcaccttgagtcatgccgcctggttattaatgttgccaaccataaatatccatggcggggcgttactggtgttatttcttttggcgttaaccgagtcaaacgatattgcacagtatttatggggaaaatcctgcggcagaagaaaagtggtccccaaagtcagcccgggaaaaacgctggaaggtctggtggggggagtaatcaccaccatgattgcgtcactgattattggaccgttactgacaccgctaaatacattacaggtattattagcgggtttgttaattggtattagtggtttttgcggcgatgtagtgatgtcagccaccaaacgagatgttggtgttaaagatagcggaaaactattaccaggacatggcggactccttgacaggattgactcattaattttcaccgctccggtatttttttattttattcgctactgctgttactgaaggaaaacagagaaaatggaaaattcacgcatccctggggagcatttttttaccaccagtgataatacagcgttgttttatcggcactggcccactttactgccaggggcgaaaaaggtcatcgtcttatttcatcgcggtcatgaacattctggtcgtctacaacatatcgttgatgaactggcgatgccagatactgctttttatgcatgggatgcccgagggcatggacaaacttcggggccgcgtggttatagtccgtctcttgcgcgttcagtgcaggatgttgatgaatttgtccgttttgctgccagcgacagccaggtcggactggaagaggtggttgtgatcgcgcaaagcgtcggcgcagtgatggttgccacatgggttcatgattatgcgcctgctattcgcggactagtgctggcatctccggcctttaaggttaaattgtatgtgccgctggcacgtcctgggctggcgttatggcatcgtctgcgtggtctgttttttattaattcctatgtgaaagggcgttatctgacccacgatcggcaacgggtggcgagtttcaataatgatccgctgatcacacgggcgattgccgtcaatatcttgctcgatctctataaaacgtctgaacgtattgttagcgatgcggcggcgattacgctccccacgcaacttctgatatcaggcgatgactatgtggtgcatcgccaaccgcagattgatttttatcagcgtttacgtagtcctctgaaagagctgcatctgctgccaggcttttatcacgacacgttgggtgaagagaacagggcgcaggcatttgaaaaaatgcaaagctttatcagccgtttatatgctaacaagtcgcaaaaatttgattatcagcatgaagaccgcacaggaccatcagcggatcgatggcggctcctttctggtggacccgtgccgttatcgccggttgatttggcgtatcgctttatgcgaaaggcgatgaaactgttcggggcgcactctgcgggcctgcatctcggaatgagtaccggctttgattcaggcagttcgctggattatgtctatcaaaatcaaccgcaaggcagtaacgcattcgggcgctttatcgacaaaatctacctgaacagtgttggctggcgcggtattcgccagcgcaaaacccatttacaaatgctgattaaacaagccgttgcccatctccacgccaaaggtttagccgtccgcgtggttgacattgccgcagggcatgggcgctatgtactggatgcgctggcaaacgagcccgccataagcgaaattttgttacgtgattacagtgaggtaaatgttgcacaagggcaagagatgattgcccaacggggaatgtctgggcgggtgcgttttgaacagggcgatgcgtttaacccggaggaactcagcgcgttaactccgcggcctacgctggcgattgtctctggcctgtatgagcttttccccgaaaatgagcaggtaaaaaactcactcgcaggtcttgccaatgccatcgatccgggtggcattctcatctacaccgggcagccgtggcacccacaactggagctgattgccggggtgttaaccagtcataaagatggtaaaccgtgggtaatgcgcgtgcgttcgcaaggggagatggattcgctcgtgcatgatgccggattcgataaatgcacacaacggattgatgtgtggggcatttttacggtttcgatggcggtgcgtcgtgataactgaacgccggaacgtattgctacaaggagctggctggttattgttgctggccccgtttttcttctttacatatggatttcttaatcagttcaccgcgactcaggatcttaacaaccatgatatccccagtcaggtattcggttgggaaacggcgatcccttttcttccctggactattgttccttactggagtctggatcttttatatggattttcgctgttcatttgtagctcgacattcgaacagcgccgactggttcaccggcttattctggcaacggtaatggcctgctgcggttttttctctatccgctgaagtttagttttatccgtcctgaagtgagtggggtgacaggatggctattttcgcaacttgaactgtttgatctgccttataaccagtctccttcgctgcatattattctctgctggctactttggcgtcactttcgtcagcatctggctgtgaggtggcgtaaagtctgcggcggatggtttttactcatcgccatttcgacgctgacgacctggcagcatcattttattgatgtcatcacggggctggcggtaggtatgttaattgactggatggtgcccgtcgaccgtcgttggaattatcagaaacctgatcaacgtcgaatcaaaatagcactgccatatgtcgcaggcgcgtgctcgtgcattgtgttgatggagctaatgataatgcttcagttatggtggtcagtctggttatgttggccagtattatcgctattcatcattggccgtgggtacggtgggcttggcgcgataacaacagggaaagatagtcaggggaaactcccgcccgccgtttactggctgacattgccctggcgtatcgggatgtggctgtctatgcgttggttttgtcttcgcctggagccggtgagcaaaattactgctggtgtttatttaggggcgtttccacgacatattccggcacagaatgcggttctggacgtcacctttgaattccctcgcggacgagcgacaaaagatcgactctatttttgtgtaccgatgttggatctggtggttccggaagagggggagctccgacaggccgtggcgatgctggaaacattacgcgaagagcaaggcagcgttctggtccattgcgcgttgggattatcgcgcagtgcgctggtggtggcggcatggctgttatgttacggacattgtaaaaccgttgatgaagtgattagttatattcgagccagacgctcgcggattgtgcttaaggaagagcacaaagcgatgctgaaattatgggaaaacaggtaagcggattgagatgtggactgaatatctacagtccacatcaagatcgtgtccggttattcagcaacaatactgtcgatggctgctttcgcgtcagactgtgctttcgctgccatttccgggccgtacgcgatcccttcggcgaagacaaatttcacatcggtaatgccgataaagcccaggaatgtggacagatacggcgtcaccagatccgttgggccatctttatggatcccaccgcggctggtgataacgatggcttttttaccggtgaccaggccttccggacccttctcggtatagcggaaagtaacgcctgcacgtgcaaccaggtcaaaatagtttttcaactgggtcgagatattgaagttatacatcggtgccgcaataacgataacgtcgtgggctttcagctcggcaatcagctcatcggaaagcgccagagcttcctgctgacgcggagtcagcggcgcatcgctcggacgcagtgcaccaaccagttcgccatccaggaccggaatcggatttgcagccaggtcacgcacggtgatttcatcagcggagtgcttttcgcgccattgttcaacaaaataatcggacaactgattagactgagagtaccctgccaggatgctggatttaagaactaataccttgctcatggtgtttccttatagatatttgaatgggcaatgccccgttgcttgttgacactttattcacaattctgccacagagatagcgcaataaatcgaagcctatgttcgaatttattgaacaacgcatagaaagccgcgatgtggtactctatatctatcatttaaaagaaaattaatcaggcagactactgcccactaacgttatgacagaacaacaaaaattgacctttactgccttgcagcagcggctggattcgatgatgctgcgtgacagactgcgtttttctcgccgtctgcacggcgtgaagaaggttaaaaatcctgatgcacaacaggccattttccaggagatggcgaaagagattgaccatgcggcagggaaagtcctgctgcgtgaagcggcacgaccggagattacttacccggacaatttgccggttagtcagaaaaagcaggacattctcgaagcgattcgtgaccaccaggtggtgatcgtcgccggggaaacgggttccggtaaaacgactcagctaccgaaaatctgtatggagctgggtcgcgggattaaagggctgatcggccatacccagccgcgtcggctggcggcgcgaacggtggcgaaccgtattgcggaagagctaaaaacggagccgggcggttgcatcggttacaaagtgcgtttcagcgatcacgtcagtgataacacgatggtcaagctgatgaccgacggtatcctgctggcggagatccagcaagaccgcctgctgatgcagtacgacaccatcattattgacgaagcgcacgaacgtagcctgaatatcgattttctgctcggctatttgaaagagttgctgccgcgacgtcctgacctaaaaatcattatcacttccgcgactatcgacccggaacgcttttcgcgccactttaataatgcgccgattatcgaagtctccggtcggacctatccggtggaagtgcgctatcgcccgattgttgaagaagccgatgacaccgagcgcgatcagttgcaggcgatttttgacgctgtagacgaactgagtcaggaaagccccggcgacattctgatctttatgagcggtgagcgggaaattcgcgataccgccgatgcgctgaacaagctaaatctgcggcataccgaaatcttgccgctttatgcgcggctttcgaacagcgaacaaaatagggtgttccagtcgcacagcgggcgacgcattgtgctggcgaccaacgtcgcggaaacgtcgctgaccgtaccggggattaaatacgttatcgaccccggtacagcgcgtatcagccgctacagctatcgcaccaaagtgcagcgtttgccgattgagccaatttcgcaggcttcagctaatcagcgtaaaggccgctgcggtcgtgtgtcagaagggatctgtattcgtctctattccgaagacgatttcctttcgcgcccggaatttaccgatccggagattctgcgtaccaacctggcctcggttattttgcagatgactgcgctggggctgggcgatatcgctgcgttcccgtttgttgaagcaccggataaacgcaatatccaggatggcgtgcgtctgctcgaagaactgggcgcgatcaccacggatgaacaggccagcgcctataaactgacgccgctcggtcgccagctctcgcagttgcctgtcgacccacgtctggcgcgtatggtgctggaagcgcagaaacatggctgtgtgcgtgaggcgatgattatcacgtccgcgctctccattcaggatccgcgcgaacgtccgatagataaacagcaggcatcggatgaaaaacatcgtcgcttccacgacaaagagtctgacttcctcgcgtttgtaaatctgtggaattatcttggcgagcagcaaaaggcgctttcttctaacgccttccgtcgcctgtgccgtactgattatctcaactatctgcgcgtgcgcgaatggcaggatatctacactcagttgcgccaggtggtgaaagaacttggcattccggttaacagcgaaccggcggattatcgcgaaattcacattgcgttgctgaccggtttgctttcgcatatcggcatgaaagatgccgataaacaagaatataccggcgcacgtaacgcgcgtttctccatcttccccggttctggtttattcaaaaagccgccgaaatgggtaatggtggcggaactggtagaaaccagccgcctgtgggggcgcattgcggcacgcatcgatccagaatgggtggaacctgtcgctcagcatttaatcaaacgcacctacagcgaaccgcactgggaaggggcgcagggcgcggtgatggcaacggaaaaagtcaccgtttacgggttgccgattgttgctgcgcgtaaggtcaactacagccagatcgatccggcgttatgtcgtgaactctttattcgccacgcgctggtggaaggtgactggcagacgcgtcacgcattcttccgtgaaaacctgaaactacgggccgaagtggaagaactggaacacaaaactcgtcgccgcgatattctggtggatgacgaaacgctgtttgagttctacgaccagcgcatcagccacgatgtgatttccgcacgtcacttcgacagctggtggaaaaaagtcagccgcgaaacgcctgatttgctcaactttgaaaagagcatgttgatcaaagaaggggcggaaaaaatcagcaaactggattacccgaacttctggcatcagggcaatctcaaactgcgtttgagctatcagtttgagcccggcgcggatgctgacggtgtgaccgtgcatatcccgctgccgttacttaaccaggttgaggaaagtgggtttgagtggcagatccccggtctgcgtcgtgagctgatcatcgccctgattaaatcgctgccgaagccggtacgccgtaattttgtgcccgcgccaaactacgccgaagcgtttttaggccgcgtcacaccgctggaattgccgttgctcgacagccttgaacgagagttacggcggatgactggcgtcaccgttgaccgcgaagactggcactgggatcaggtgcccgatcacctgaaaatcactttccgcgtggtggatgacaaaaacaagaagctaaaagaagggcgctcattacaggatctgaaagacgccctgaaaggcaaagtgcaggaaacgctgtctgccgtggcggatgacggtatcgagcagagcggtttacatatctggagttttggtcaactgccggaaagctacgagcagaagcgcggcaactacaaagtgaaggcgtggccggcgctggtggatgagcgtgacagcgtagcgatcaaactgtttgataacccgctggaacagaagcaggcaatgtggaacggtcttcgccgtttactgctgctaaatattccatcgccgatcaagtacttgcacgaaaagctgccaaacaaagccaagctggggctgtactttaatccgtatggcaaagtgctggagctgatcgatgactgtatctcctgcggtgtggatcaactgatcgacgccaatggtggcccggtctggacggaagaaggctttgctgcgctgcatgaaaaagtccgcgctgaactgaacgacacggtggtggatattgcgaagcaggtcgagcaaatcctcactgcggtgttcaatatcaacaaacgtctgaaagggcgggtggatatgaccatggcgctggggctttctgacattaaagcgcagatgggcgggctggtgtatcgcggttttgtcactggcaacggttttaaacggttgggcgacacgttacggtatttgcaggcgattgaaaaacgactggaaaaactggcgattgatccgcatcgtgaccgtgctcagatgctgaaagtcgaaaacgtccagcaggcatggcagcaatggatcaacaaactgccgcctgcacgtcgtgaggatgaagacgtgaaagaggtccgctggatgatagaagagctgcgcgttagttacttcgctcaacaacttggtacgccttatccgatttcggataagcgtattttgcaggcgatggagcagattagcggttaacactgctatttgcctgataaatctaaaacccggtaagcatttagcgccgggttttttattaattctaaaaacgataagggaaaaaattcaggagttcagaaaaatacaattctctgctgcaagatgaataatgtttatctacagcatttccttaaaaaatatgtcaggcttgcggagtggcagttaaggaaatacgacctcctcctttcagagtgctccgcttctcactattatctcacgcagtattcttaagggaacgataaggaggaaccatgaatattaccccgtttccgacgctttcgccggcaaccatagatgccataaatgttatcggacagtggctggcgcaggatgatttctccggtgaggtgccgtatcaggccgattgcgtgatccttgcaggcaatgcggttatgccgactatcgatgcggcatgtaagattgcccgcgatcagcaaattcctttactgattagtggtggtatcggtcactcgacaacttttttgtatagcgccatcgcacagcatccacactacaacactatccgcaccactggcagagctgaagctaccatcctggcggatatcgctcatcagttctggcatattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtataaccggggataatcccgatgcaccacgctggttaagttatcccggattcgttcctcagttaggaaataacgcagacagtgtaatctttgttaatccgttgcaaggattatggccggttgagcgttatctatcgctactcactggcgagctgccgcgtttacgcgatgatagcgatggctacggcccccgcgggcgagattttatcgttcacgttgattttccggcagaagtcatccaggcatggcaaacgctgaaacacgatgcggtgctcatcgaggcgatggaaagtcgctcgttacgttaaaaattgcccgttcgtgaaccaattgtttgcaaacgggcatgacttctgacttttatttctgcctttaattccttttacacttgtttttatgaagcccttcacagaattgtcctttcacgatgccgtctctctgataattgatgttaattaacaataaatttaccaaaaacaaacatgcaaatcacaggagtcgcccatgtcagtacccgttcaacatcctatgtatatcgatggacagtttgttacctggcgtggagacgcatggattgatgtggtaaaccctgctacagaggttgtcatttcccgcattcccgatggtcaggccgaggatgcccgtaaggcaatcgatgcagcagaacgtgcacaaccagaatgggaagcgttgcctgctattgaacgcgccagttggttgcgcaaaatctccgccgggatccgggaacgtgccagtgaaatcagtgcgctgattgtcgaagaagggggcaagatccagcagttggctgaagtcgaagtggcttttactgcggactatatcgattatatggcggagtgggcacggcgttacgagggcgagattattcaaagcgatcgtccaggagaaaatatccttctgtttaaacgtgcgcttggcgtgactaccggcattctgccgtggaactttccgttcttcctcattgcccgcaaaatggctcccgctcttttgaccggtaataccatcgtcattaaacccagtgaatttacgccaaacaatgcgattgcattcgccaaaatcgttgatgaaataggccttccgcgcggcgtgtttaaccttgtactcgggcgtggtgaaaccgttgggcaagaactggcgggtaacccaaaggtcgcaatggtcagtatgacaggcagcgtctctgcaggtgaaaagattatggcgactgcggcgaaaaacatcaccaaagtgtgcctggaattggggggtaaagcaccggctatcgtaatggacgatgccgatcttgaactggcagtcaaagccatcgttgattcacgcgtcattaatagtgggcaagtgtgtaactgtgcagaacgtgtttatgtacagaaaagcatttatgatcagttcgtcaatcggctgggggaagcgatgcaggcggttcaatttggtaaccccgctgaacgcaacgacattgcgatgggaccgttgattaacgccgcggcgctggaaagggttgagcaaaaagtggcgcgcgcagtagaagaaggggcgagagtggcgttgggtggcaaagcggtagaggggaaaggatattattatccgccgacattgctgctggatgttcgccaggaaatgtcgattatgcatgaggaaacctttggcccggttctgccggtggtcgcatttgacacgctggaagaggctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgctggatggcgtaaatccggtattggcggcgcagatggtaaacatggcttgcatgaatatctgcagacccaggtggtttatttacagtcgtaatgagtgaaagaggcggaggttttttcctccgcctgtgcgcgtcagagtttagcgaatttttcgagggtgcgaataagctgcgtgacgaagccatattcgttatcgtaccaggcgaccgttttcaccagttgtaaatcgcccacggcggtaatttccgtttgcgtggcatcaaacaccgaaccgaaatggctgccaatgatatcggaagagactatttcttcatcagtataaccaaatgactcgttattgtttgtcgcctttttaagcgcgttgttcacctcttcggcagtcactttctttccgagaatcgacaccagttcagtgaccgaacctgttttcaccggcacgcgttgcgcatgacctttcagtttgccgctcagttccgggatcaccagaccaatggcttttgccgcccccgtagtgtggggaatgatattttctgccgctgcgcgtgaagcacgtaaatctttaccacgtgggccatccaccagtgactgggtgccggtataggcatgaatggttgtcatcgtgccgacttctatcccgaaactgtcatgcaaggctttggccatcggcgcaaggcagttagtggtgcatgacgccacggaaacaatggtgtcgttgccatccagagtgtcgtcattgacgttataaacgatggttttcatttcaccggcaggggcggaaatcaacaccttcttcgcgccagcatcaagatgcgcctgcgatttctcggcggaggtataaaagcctgtacattcgacaatgatttctgcgcctttcgctttccacggaatatttttagcctctttttcggcgtaaaccgcgatacttttcccatcaacgataagtgaatcttccgtataatcaacgctccaggggaacggtccgtagtttgaatcatgtttcagcaggtaggcgagaatttttggggaagtgagatcattaatagcgacaacgtctatgttgcttttgacttcaagtaatcgacgcaacaccagtcgaccgatacgaccaaaaccattaataccaactttactcatggtcttctcctgtcaggaacgttcggatgaaaattgatcctttccaggcttagaccaggatggcgggatgggcaatctacattcttgcagtgaaacgtaacgtactgaaaacgggtgaacaatatttaatgaaattttaagaaaagcccgttatgttaacggcaaattatgttaaagcaggaaatgttatgggaaataaatactcaaggttacaaatcagcattcactggctggtctttttgctggttatcgtagcgtattgcgcaatggagtttcgtggtttcttcccacgtagcgatcggcccctcatcaacatgattcatgtttcctgtggcatctcaattctcgtactgatggtggttcgtcttttgttaaggctgaaatgcccaaccccgccgattatacctaagccaaaaccgatgatgacgggactggcgcatttgggccatttggtgatttatctcctgtttattgcgctgccagtgattggtttggtgatgatgtataaccggggcaacccgtggtttgcgtttggtttgacgatgccttacgcttcagaggccaatttcgagcgggttgatagcttaaagtcgtggcatgaaacgctggcgaatctgggatattttgtcatcgggttgcacgctgcggctgcactggcacaccactatttctggaaggacaacacacttctacgcatgatgccgcgtaaacgttcctgaaggatatttaaagaaaacgcctgtactaaaaccgacccgtggtacaggcgaagaatacgggcctacatcggaagcgcctattatatttatttgtatgacaaataaaaccataatccttgtctatacgtccatctggcttatctttaatcaattcacccgatctttgatctcatcaacggtatcaaaataaaccagcgtataacgttcaaatcgaacataagattcgataaatcatggaggttatatgaaaaaactggcacttatcctggttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactgaagtgtaaaaggggtgccatgagaaaatgaatctgctagtcagatgcgcggggaaaatccccgcgcttgcccttacctggacgtgcaggccatgagcgcagcaacctccttatcaccgtcccggaaccgcagttcgtagagcgtttgtcgggtcaggagtgtgaatgtcagaatcgtaatgcagataatgagcagacacaccaccagagggttgcgcttcatagcctttctccttgccggatggcgggtaagaggctaacatttgaattgcttggttcattcgttggcctcggttgatagaaatatcggtcggggccttcgtctttctgattcccggttagcctgaaaacagaaagtctcaggcacccgcaggcatcctatgaggtttccttagggacgaaaataatcacttgacgaaattgcgtgctgttttccagaatttttcgtcattcggtttagccgttcgttactctcttcattccaatggcattatttttctctgccataattgttgtaaaaatgtgacgcaaagaggtttttggtcataagtaattaccgtcaagtgccgatgactttctatcaggagtaaacctggacgagagacaacggtaatgaatacaactccctcacagcgattaggttttttgcatcacatcaggctggttccgttatttgcctgcattcttggcggtatcttagttctattcgcattaagttctgctctggctggctatttcctctggcaggccgatcgcgatcagcgtgatgttactgcggagattgagattcggaccggttagcgaacagttcagattttttgcgttcagcccggatcaatatgattcaggccggggcagcgagtcgtattgcggaaatggaagcaatgaagcgaaatattgcgcaagccgaatcggagattaaacagtcgcagcaaggttatcgtgcttatcagaatcgatcggtgaaaacacctgctgatgaagccctcgacactgaattaaatcaacgcttccaggcttatatcacgggtatgcaacccatgctgaaatatgccaaaaatggcatgtttgaggcgattatcaatcatgaaagtgagcagatccgaccgctggataatgcttataccgatattttgaacaaagccgttaagatacgtagcaccagagccaaccaactggcggaacaggcccatcagcgcacccgcctgggtgggatgttcatgattggcgcgtttgtgcttgccctggtcatgacgctgataacatttatggtgctacgtcggatcgtcattcgtccactgcaacatgccgcacaacggattgaaaaaattgccagtggcgatctgacgatgaatgatgaaccggcgggtcgtaatgaaatcggtcgcttaagtcgtcatttacagcaaatgcagcattcactggggatgacagtagggactgttcgacagggtgcggaagagatttatcgtggcaccagcgaaatttcagctggcaatgcggacctgtcatctcgcaccgaagaacaagcggcggctatcgaacaaactgccgccagcatggagcaactcactgcgacggtgaaacagaatgcggataacgcgcatcatgccagcaaactggcgcaagaggcttctattaaagccagcgatggcgggcagatggtttccggtgtagtaaaaacgatgggcgctatctccacgagttcgaagaaaatttctgagatcaccgccgtcatcaacagtattgctttccagacgaatattctggcactgaatgctgccgttgaagccgcgcgagcgggtgagcaaggccctggatttgccgttgtcgccagcgaagtacggacactcgcaagccgcagcgctcaggcggcgaaagagattgaaggcttgatcagtgaatcagtcaggttaattgacctgggagcggatgaggtggccacggccgggaaaaccatgagcactattgttgatgccgtcgcgagtgtcacacatatcatgcaggaaatcgccgccgcctcggatgaacaaagcagaggcataacacaggttagccaggcgatttctgaaatggataaggtgacgcaacagaatgcttctctggtagaagaggcctcagcggcggcggtgtcccttgaagaacaggcggcacgattaactgaggcggtggacgtattccgtctgaacaaacattctgtgtcggcagaacctcgcggagctggtgaaccagttagtttcgctacagtgtgaaaatgttaaaggagggatcgacagatcccttcacctttcagaacggcattgattttcgaatagcgttaatcatcaactggcaaccagaagagaacgtcgcatctacgcgggtcagtattccaatcggttcgcctgcaccatgtcccggaacaggcagggctaccagcgtggcatgacgcaggtcgtcttttacagcgccagaagggacaaaccacacgtaatcgtattcaaccgtaagttgacgagatagcgaagcagacagcgtttcgatacaacccgaaggaattttacatccctggctctgcactaatgcatctgaatgctggcgtggcgcagtgccttctggtgatacaacgaccggccattccagcacccggcttagcgttacgttctcctgaagtagcgggtgattagggcggacaaccagcttcagcgattcaagaaacagcagttcgtaattaagcccgttcatcagttcaggatctgacatccgaccaatgccgatatcgatttccccggtttttaaacccgccagaatcatagggttactcattgtcgcaacttgcaaggtcgtctctttttgttgctgatgaaactgacctataaccgaaggtaatatccctagtgccgcagtaggtagcgcaccaaccctgacgacatcattattaagaccttctttacgatgaagcgactgtccggcagtgttgatggcgtcaagaactctgactgcatgcgttaaaaattgttcgccgggtaaggtaagttgcgccccctgacgaccacgctcaaacaagcgagcgcccgtcagctgctccagttcattcaatgtcttagagagcgcaggttgactcaaattaagggtttcagccgcgcgccccaaagttccttgttgtgcgacagctacgaatgtatgaaggtggcgcaaacggatgcgctgactaaacagactatttttttccataagcgatgttaaaaacgaagcggtgtcgctgacaagtgaagttgttttattatgataacttgattgcaaaatattattaacaattaaagcaactatgttacagcaaaatggataatattgatgttttcgcggcgagatcacagtttgtaaattcttccagccggagtgaatgcggttacctacactccagattactgaccactggaggcagacactatggcgaacagcatcacggcggatgagattcgggaacagttttcgcaggcaatgtcagccatgtaccagcaagaagttccgcagtacggcacgctgctggaactggtagctgatgtaaatctggcggtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcaggggtgccggtacattcgacagcatttcggcccattgatgatgcttctctggcgcgtaatcccttccgcgtttttacctcgttactccgtcttgagcttatcgagaacgaaattttgcgccagaaagcggcggagattctgcgtcagcgcgatatcttcaccccacgttgtcgacaactgttagaggaatatgagcagcagggcggttttaacgaaacacaggcacaggagtttgtgcaggaagccctggaaacgtttcgctggcaccagtcagcaacggtagatgaagaaacctatcgcgccttgcacaacgaacatcggttgattgctgatgtggtctgttttcctggatgccatatcaaccatctgacgccacgcacgctggatattgaccgggtgcagtcgatgatgcctgaatgcggaattgaacccaaagttctgatcgaagggccgccgcgccgcgaggtgccgattttactacgccagaccagctttaaagcactggaagagacggtgttgtttgcggggcagaaacagggcacgcataccgcgcgctttggtgaaattgagcagcgtggtgtggcattaacgccgaaagggcgacaactgtatgatgatcttctgcggaacgctggaaccgggcaggataatctcactcaccaaatgcatttacaggaaaccttccgcacttttcctgacagtgagtttttaatgcgtcagcaagggctgggatggttccggtaccgtctgacgccttcgggtgaggcgcatcgtcaggcgattaatcccggagacgatccacagcccttaatagaacgtggttgggtagtggcgcaacccattacctatgaagatttcttgcccgttagcgcggcggggatcttccagtcaaatctgggtaatgaaacgcaggcatgcaatcacggtgatgccagtcgcgaagcatttgagcaggcgttggggtgtccggttttggatgagttccagctttatcaggaagcggaagaacgcagtaaacgtcgctgtggtttgctttaaattctgaccatccgcctttgcaaaaatttgcctgattttacaaacgaatcaggctcatcccatcgacataaaaaaaatgccaatttatgcatattctctgatttcaacaattggattattaataaatattgtctagagtgagcggtcataaataagcactttcttgccgctgaaaatgaccagcgcgggaccattcacaacaccagaaggactcactttcaggtatggatcgtagacgatttattaaaggttcaatggctatggccgccgtgtgcggtaccagcggcattgcttctcttttttctcaggcggcattcgcggccgattctgatattgccgacgggcaaacccagcgttttgacttctccattctacagtcaatggcgcacgacttagcgcaaacagcatggcgtggtgcaccacgtccgttacctgacactttggcgacaatgacgccgcaggcttataacagtattcaatacgacgccgaaaaatcgctctggcataacgttgagaaccgtcaactggacgctcagtttttccatatgggaatgggattccgtcgccgcgttcgtatgttttctgtagatccagcaacacatctggcgcgtgaaattcactttcgcccggagttgttcaaatacaacgatgcgggtgtggataccaaacaattagaagggcaaagcgatctcggttttgccggttttcgcgtgtttaaagcccccgaactggcgcgccgtgatgtagtatcattcctcggcgcgagttatttccgcgccgttgatgacacatatcaatacggtttgtcggcccgcggcctggcgatcgacacttacaccgacagcaaagaagagttccccgactttaccgccttctggtttgatacggtaaaaccaggggcaaccacctttactgtttatgcgttgctcgatagcgccagcattactggtgcctataagttcactatccattgtgagaaaaatcaggtgattatggatgtggaaaatcacctgtatgcgcgcaaagacattaaacagctgggcattgcaccgatgaccagtatgttcagctgcggtactaatgaacgtcggatgtgcgacaccattcatccgcaaatccatgactctgatcgtctgtccatgtggcggggcaacggcgagtggatttgccgtccgctgaacaatccgcaaaaattgcagttcaatgcttacaccgacaacaacccgaaagggtttggtttattgcaactggatcgtgatttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcgggtgatgagtttgcattccagtatcgtctgtactggagtgcgcaaccgcctgttcattgcccattagcgcgcgttatggcgacgcgtaccggcatgggcggtttcccggaaggttgggcgccaggtgaacactatcccgaaaaatgggcgcgacgttttgccgtcgatttcgttggtggtgatctgaaagctgccgcgccaaaaggcattgagccggtgattacgctttccagtggggaagcgaagcaaatcgaaattctctatattgaacccattgatggttatcgtattcagtttgactggtatccgacttcggactccactgatccggtcgatatgcggatgtatctgcgttgtcagggcgacgctatcagtgaaacatggctgtatcagtatttcccgccagcgccggataaacgtcagtatgttgatgaccgcgtgatgagttaatcgttttttcttcggcatcttcttcgggaggtgccgtctggttaaacacgatcccgctcgcatttttccctaagttaaatgagtaatctgatggtgtgtatttcagatacaccttgtcagccactaacagggagtgcgtatgtttccagaataccgagatttaatatcccgtctgaaaaacgaaaatcctcgctttatgtccttgttcgataaacacaataaacttgatcatgaaattgccagaaaggaaggttccgacggtcgagggtacaatgcggaagtggtccgcatgaaaaaacaaaagctacagttaaaagatgagatgctcaaaatcctgcagcaggtgagcgtcaaagaggtgtaaactttcctaagccgccagccaggcggcttttttaacagctgcatggattgactggagataagatgactgaaacgataaaagtaagcgaatcacttgaattacatgctgttgcggaaagtcatgtcacacctctttatcagttaatctgtaaaaataaaacctggttacagcagtcgctaaactggccgcagtttgttcaaagtgaagaggacacgcgaaaaacggtgcagggtaatgtgatgttgcatcaacgcggctatgccaaaatgttcatgattttcaaagaagatgaacttatcggcgttatctcttttaatcgtattgaaccactgaataaaaccgctgaaatcggctactggctcgacgaatctcatcaggggcaggggatcatttctcaggcgctgcaggcattgattcatcattacgctcagtctggtgaacttagacgcttcgtgatcaaatgtcgggtggacaatgcgcaaagcaaccaggtcgctttgcgcaatggttttatccttgaaggttgcctgaaacaggctgagttcctgaatgatgcctatgatgatgtgaacttatacgcgcgtattatcgattcacaataaccctgccagcagcgttcgcgtaatgcgctcctcgccgttaatgacttttggaccacggacatgaatcgtgtcgccatcaaaggcttcaacgacggcgtggtcagttaactccacatggttttcaattatcaccgcacctgtaatacggctctcaccttgtatgacaacgtgctcgtcgagcagaatcggtccgccacgtaccacggcatttccgccaatcaagacatgatgttttaacacacaattaccttccacaatggcatattccgccacctgtgaactgtaatgaatcgtcggaatggcatcttcttctatgccagctttcacctgcgcgtgaccgtagactttagcgcaatcgcatagccagacgttgttctcttcattaccttcaacactggcaaaatcaaaaacttcggcgcgatgttcaataaaagcataccggacgacggcatcgccataaatttgtgcctggtggacaatacgcgaggcgctaacctttgcgcgatcataaatttgtagcaggagttgatggtcgggcgttaagccttgtgcggcgacgatcatagaatgttgatcaattaaggcgtgaccaaatattctacattgaccacaaactaatgagtcacgaatggtgacactgtcacttatatatgcaccctggctgatttcactattatcgatccagacattatccgttgcgtaaacctctccccacagcacgctggtgccagtgatacgcgtattcccggaaatcaccgttccgccgaacgcaatagcattctggtcgtaaatccagcaatttccttcctgtgctaacaccgtttcgtgatcgatccagccgccagcgcttcctgctatcacatcgttaaaatcgctcatggcgataatttgccgtaataacacactttttttagtgccatcttcctgataactaaaggctcgctgttcttcacttagacgatatttacgcatagcgttttcccacaggtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccaggtttggcaggtcagccactggttgggtgatgggctggtgattctggcgatgatcatctggggattattgacaggcgcatttattacccgactcatacgctttccgcatagcgtgctggcagaagtgcgccatccagtgctgagcagttttgtgagtttgtttccggcaacgacgatgctggtggcgattggttttgttccgtggtttcgcccactggcggtgtgcctgttcagttttggtgtcgtggttcagttggcttatgccgcctggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagcctggaaccggtgatcttgcagcgtctgcgcagttcgggagaattacccacggcactgcggacatcactcggcattcagctcgctcctgcgctggtggcctgtagtgcctggctgagcgtcaacggcggcgagggtgacacgctggcgaaaatgcttttcggttatggactgctgcaactgctgtttatgctacgtctgatgccatggtatctctcccagccatttaatgcttcattctggagtttctcgttcggtgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttagtcagaaccgagcgcgccgttttaatgaaagcagaggacaaagaatgatcattcgtgatgaaaactattttactgataaatatgaattaacccgcacacactctgaagtgctggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaagtccattgaaaatctggataatttacacacccgggtcgttgatctgaataacctcacatttgatggacagtacgattttattctttcgactgtggtgctgatgttccttgaggctaaaaccatcccagggctgattaccaatatgcaacgttgcactaaacctggcggttacaacctgattgtggcggcgatggataccgctgattatccatgtaccgtcggcttcccgtttgcattcaaagagggggaattacgtcgatattacgaaggctgggagatggtgaaatacaatgaagacgtcggcgaactgcaccgcaccgacgccaacggtaatcgtattaaactgcgtttcgccacgatgctggcacgtaaaaaatgatccggtaagaacaaagcgcgtgaaaattccccacgctgagatggtttactgttcttcttttcggtaagcatattttttatcgaagggatgtgaaattaatcacagtagtcgaagttttttagccgcttaacttactgaaatttaactactgatgattgacttagcccctttttcggcattgactatgtcgtctgaaaaggggctaaaaaatttattttcaccaacactttttttgccacaacacgaagcggcgctttttgctataacttagaaagtaatataatcatctcaggaaactattcatgcgtaccacatcatttgcgaaagttgcagctttatgcggcttgttggctctgtctggttgtgcctctaaaatcacccagccagataaatattctggttttttaaacaattactctgatttaaaagaaacaacctcggcaacaggtaaacctgttttacgttgggtagacccgagttttgatcaaagcaaatatgacagcatcgtctggaacccaatcacttattatccggtaccgaaaccttctacccaggtagggcagaaagttctggataaaattttgaactataccaacaccgaaatgaaagaagcgatagcgcagcgtaaaccactggttaccaccgctgggccgcgtagtctgattttccgtggggccattaccggtgtagataccagtaaagaagggctgcaattctatgaagtggttcctgttgcattagtggttgcggggacgcaaatggctacaggccaccgtaccatggatactcgcttgtattttgaaggtgagctgattgatgcagcgactaataaaccggttatcaaggtcgttcgtcagggcgaaggtaaagacctgaataacgaaagtacgccaatggctttcgaaaatattaaacaagttattgatgacatggcgaccgatgccaccatgtttgacgttaacaaaaagtagttccagacgcgccatcgttagatggcgctttttattatcggtttctgtcagcgattaaattcaacaccacgtaactaacgcctccggcaattaatccccaaaacgcagaaccaatcccgaccagcgtcaatccacttgccgttaccagaaatgccaccaccgccgcgtcgcgctcacgctcattatgcagcgcctgatacaaactgccgccaatggtactcaacagcgccagacctgccagcatctggatccaacttacgggcagggcagccatcatcccggtaatggcactaccaaacagacctgcgagcaaatagaaaatgcctgcaacggcagcggccagccaacgttgatctttatccggatgcgcttccgggctttggcaaatagccgcggtgattgccgcaataccgatggaataaacgccgaaaggggaaaaaacaagcgccagcaatccagtaaacacaatcaacggcgaaacaggagccgaatacccggctgctttcattgctgcgatacccggtgcgttttgcgatgccatcgtcaccagaaaaagggggagtgcaacgctcagactgtgagcaaacgaaaaatcagggggaatataagtggggagaacgggtttaaagacaacatcagttgtgacaacgtcaccttgcgcgataacgatcacgatcccaataatcatcgcggcaattaccgcatagcgcggcgcaacggtcttggctgccagccatgccagcaacatactgccacacaacgtaaattgaccatccagactggcaaacgcctgtaaaccaaaacgtaataaaatcccggcaagcattgccgccgcaagcgagtgcggaataatgcgcatcagacgagcaaagagtcccgttatgccgcagaggactattaacacgttggtgacaataaaaacgccgatggcttcgttaagtgttagtccctgtaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttataacgtacaggtaccgtagcatttgtccgttataacgcacaagtgataaacttccgttttgccggaggagtcgcatggaaaatctcgctcgctttttatccaccacacttaaacaactacgtcagcagcgcggctggagtctttcgcgactggcagaagcgacgggcgtttctaaagcgatgttagggcagattgagcgtaatgaatccagcccgacggtcgcgacattatggaaaattgccaccgggttgaacgtgccattttcaacatttatttctccgccgcagtcctctacgccttcagtttatgatccacaacggcaggcgatggtgatcacttcgctgtttccttatgatccacaactctgctttgaacacttctcgattcagatggcacccggtgcaataagcgaatcgacgccccatgaaaagggggtaatcgaacatgtcgtcgtcattgatggacaacttgatctgtgtgttgatggtgaatggcagagccttaattgtggggaaggcgttcgatttgctgcagacgtcacgcatgtctatcgtaatggtggggagcaaaccgtacattttcattccctcatccattacccgcgcagttaagcgggaaaactatttcgcaacgtcgcgcttgtggctaaaatagccgccatttttcagctactggataagaaagtgaccgtatcttctcatcgtcttgaactgttaagcccggcacgcgatgccgccattgcccgcgaagctattttgcacggtgccgatgctgtttatatcggcggccctggttttggtgcccgtcataatgccagtaatagcctgaaagatattgccgagttggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgatattcgtacagtagaaaaagcgaagttcctctctgatgttggcttcacgcagattgtgctggcgcgagagctgaatcttgagcagatccgcgcgattcaccaggccacggacgcgaccattgaattctttattcatggcgcattgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggcgtacgctccttcaagattgaagggcgttacaaagatatgagctacgtgaagaatatcaccgcccattatcgtcagatgctggatgctattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtgggcgaagtattgaaagtagcgaaagatcatctcgatgttgccgttaccgaaccactggcaaatggcgatggcctgaacgtgatgattaaacgtgaagtcgtcggttttcgtgctaatacggtagagaaaaccggagaaaatcagtaccgcgtctggcccaatgaaatgccagcagatttgcacagaattcgcccgcatcacccactaaaccgaaatcttgatcataactggcagcaggcactgacaaaaacctccagcgaacgccgggtggcggtagacattgaactgggcggctggcaggaacaactgattctgaccctgaccagtgaagagggcgtcagcgtcacgcatacgctggatggacaattcgacgaagctaataacgccgaaaaagcgcttaataacctgaaagatggtctggctaagctggggcaaaccatctattacgcccgcgatgtgcaaattaacctgcctggtgcgctgtttgtaccaaacagtctgttaaaccagttccgccgtgaagccgccgatatgcttgatgctgcgcgtcttgccagttaccagcgcggcagccgtaaaccggttgctgatcctgcgccggtttatccgcaaacgcatctgagtttcctcgcgaacgtatacaaccagaaagcgcgtgaattttatcatcgctatggtgtgcaactgattgacgcggcgtatgaggcacatgaagagaagggcgaagtcccggtgatgatcaccaagcattgtctgcgctttgccttcaatctgtgcccgaaacaggcgaaaggcaatatcaaaagctggaaggcgacaccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgatctgctgaaaacattgccgaagcgaaaagggtaaaacgccagttttcgggttactcaccactcatcaaatctgcatgatattgcctgctgggtaaggtgtcacgccgcatccggcaacacacgactcaacgctgtcccgcttctggtttgcgcgatttttgccagtaaaaatgctcgcgcaaaccttccgccgactcttccgccacagcacgcaattcatcgctgtccgcttcatgacgcagctgatgatccacattctttacccacataaattcatgtcctttgtgccctgccatgagttgtcctgagaacagtgcacacgttaataagacaaccgataacgccttcgaaaacatcccgccacctttttctgaccttttgccgctatgatgccgatcgtttcttgaggttattattcagttttgcaaattagagcaaagaaattctggaatcttccttcctgattttgcattgcattctgccgttgcggcgatttagtgctattttcgagcacattacacacggaggtaaacttcgccattaaatagtcacgatcactttattgaagtgcctttgagcgtcgcctctaaggtattgctgttaaatgcttttttacagtcagaaatcactcagcaagggttagccaggcgaattggcaaacataaacaggagattactcgcctatttaatttgcaccatgcgacaaaaatcgacgccgtccagctcgcggctaaggcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttctggcatgagctttatgactgtcagccatgcctatcagttgctcgaaagtcagggatatattatcgcgcgaccgcaatcgggttattacgttgcgccacaggcaataaaaatgccgaaagcgacagtcattccagtcacacgagatgaagcagtcgatatcaacacctatatttttgatatgttgcaggccagtcgcgatccgtcggtagttccgtttgcctcggcctttcccgacccgcgacttttccccctccaacaactaaaccgctcgctggcgcaggtaagcaaaaccgccacggcgatgagcgtgattgaaaacttaccgccaggaaacgtagaactgcgtcaggctattgctcgtcgctatgccttacagggcatcaccatttctcctgatgaaattgtcattaccgccggggcgttagaggcattaaacctcagtttgcaagcggtaactgaaccgggcgattgggtgatagtagagaatccttgtttctacggcgcgttgcaggcgctggagcggttacggctgaaggcgttatcggtagcgacggatattaaagaagggatcgatcttcaggtgctggaactggcgttgcaggagtatccggtgaaagcgtgctggctgatgactaatagccagaacccacttggatttaccttaacgccgcagaaaaaagtgcggctggtagcgttgctcaatcagtacaacgtaacgctgattgaagatgacgtttatagcgaactttattttggacgggaaaaaccgctgcctgcgaaagcgtgggatcgccacgatggtgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcagcttgcgctggtggattacctttctactcgccgatacgatgctcatcttcgtcgtctgcgtcgccagcttgcggaacgtaaacaacgcgcctggcaggctttgctgcgttatctgcctgcggaagtcaaaattcatcacaatgacagcggttattttctctggctggagctccccgagccgttagatgcaggagaattaagcctggtggcactgacgcatcatatcagtattgcgccgggtaaaatgttttctaccggtgaaaactggtcacgtttttttcgttttaataccgcgtggcagtggggagaacgtgaagaacaggcggtaaaacaattaggcaaacttattcaagaacggctgtaatagcgtttaatttaattcctctcaggttgggtaatatgaatttcgaatagcagtcatatatcctaactccttgtctatactccagaagataaccttacagacggcataatgcgcggtagctcacaacctgattaaattttctcagggccgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagagaatccggaagggcgactggatattatcgcctggccgggatacatcgaacgcggacaaactgataaacagtacgactgggtaacgcaattcgaaaaagagacaggctgcgcggtgaatgttaaaaccgccgcgacttccgatgaaatggtcagtctgatggccaaagggggttacgatctggttacggcatccggcgatgcctcgctgcgtttgattatgggcaaacgcgtgcagccaattaataccgccttgattcccaactggaaagcgctcgatccgcgcgtggttaaaggcgactggtttaacgttggcggcaaagtttacggcacaccttaccaatgggggccgaacctgctgatgtacaacactaaaaccttcccgacgccgccggatagctggcaagtggtttttgttgagcagaatctgccggacggcaagagcaataaaggccgggtacaggcttatgatggccctatctacattgcggatgccgcgttgttcgtcaaagccacgcagccacagttgggcatcagtgatccgtatcaactcaccgaagaacagtatcaggcggtgctgaaagtgctgcgcgatcaacataatttgatccatcgctactggcatgacactaccgtgcaaatgagcgatttcaaaaacgagggtgtggtggcttccagtgcatggccctatcaggccaacgccctgaaagccgaaggccagcctgtcgctaccgttttcccgaaggagggcgttaccggttgggctgacaccaccatgctacatagcgaagcgaaacatccggtttgcgcctacaaatggatgaactggtcattaaccccaaaagtgcagggcgatgtggcggcctggtttggctcgttaccagtagtgccgcaagggtgtaaagccagtccgttattaggcgagaaaggttgtgaaacaaacggttttaactatttcgataaaatcgccttctggaaaacgcctatagcagaagggggcaagtttgttccctacagtcgctggacgcaggattacattgccattatgggcggtcgctaacttcgctggggtgttttatgacgtacgcagtggagtttgacaacgtctcacggttgtacggtgacgtgcgcgcagtagatggcgtcagtattgcgataaaagatggtgagttcttctctatgctggggccgtccggctccggcaaaaccacttgcctgcgcctgattgctggattcgaacagctttccggcggggctatctctatttttggtacgcccgccagcaatctgccaccgtgggagcgggacgtgaatactgtcttccaggactacgcgctatttccgcatatgtcgattcttgacaacgtagcctacgggctgatggtcaaaggcgtgaataaaaagcagcggcatgcaatggcgcaagaggcgcttgagaaagtggcgttggggtttgtacagcaacgtaaaccgtcacaactttctggtggtcagcgccagcgagtcgccatcgccagagcactggtgaacgaaccgcgtgtgttgttgctggatgaaccgctcggcgcgctggatctcaaattgcgagagcaaatgcagcttgagctgaaaaagctgcaacagtctctcggtatcacttttatcttcgttacccacgatcagggcgaagcgttatcgatgtccgatcgggtggcggttttcaataatggacgcattgaacaggtcgattctccgcgcgatctctatatgcgcccgcgcacgccgtttgttgcgggattcgttgggacatcgaatgtttttgatggactgatggcagagaaactttgtggcatgacgggaagcttcgcactacgaccggaacatatccgcctcaacacccctggcgaaatgcaggctaatggcacgatccaggcggtgcagtatcagggcgcagcgacccgttttgaactgacactgagcggcggtgaaaaactgctggtgagtcaggccaatatgacaggcgaagaactgcctgccacgctcacgcccggacaacaggtgatggtttcctggtcgcgtgatgtgatggtggcgctggttgaggagaggtgaatggcgatgaacgtattgcaatcaccttcacgtccaggtctgggtaaggtgtccggtttcttctggcgtaatccggggctggggctgtttttgctgctgcttggcccgctaatgtggtttggcattgtctatttcggctcgctgctgacgctgttatggcagggcttttatacctttgacgatttcaccatgtcggtaacgccggaactgacgctggcgaatatccgtgcgctgtttaatccggcgaattacgacatcattgtccgcacgctgaccatggctgtggcagtcactatcgccagcgccattctggcttttccaatggcgtggtatatggcgcgctataccagcggaaaaatgaaagcgtttttttatattgcggtaatgttgccgatgtgggcgagctacattgttaaagcctatgcctggacgttattgctggcaaaagatggcgtggcgcagtggtttttacaacatctggggctggaaccactgctgactgcgttcctcacgctaccggcggtgggcggcaatacgctgtcaacttccgggctggggcgctttctggtgtttctctatatctggttgccgttcatgatcctcccggtgcaggcggcgcttgagcgtttgccgccgtcattgttacaggcgtcggctgatcttggcgcacgtccacgacaaacctttcgctatgtggtgctgccgctggcgatcccgggtattgccgctggctctatctttaccttctcactcacgctgggcgattttattgtcccgcagctggttggccctccaggatattttatcggcaatatggtttattcccagcagggggcgattggcaatatgccgatggcggcggcattcaccctggtgccgattgttctcatcgcactttacctggcgttcgtgaaacgtctgggagcgttcgatgcactctgaacgcgcaccgtttttcctcaaactggcggcctggggcggcgtggttttcctacattttcccatcctgattatcgctgcctatgcgtttaacactgaagatgcggcgtttagttttccaccgcaaggcctgacgctgcgctggtttagcgtggcagcacagcgtagtgatattcttgatgccgtgacactgtcacttaaagtggcggcgctggcgacattaatcgcgctggtgttagggacgctggccgctgccgcgctgtggcgacgagactttttcggcaaaaacgccatttcgctgttactgttgctgcccattgcgctgccgggcattgtcactggtctggcgctattaaccgcttttaaaaccatcaatctggagccgggatttttcaccatcgtggtcggtcatgcgactttttgcgtagtggtggtgtttaacaatgtcatcgcccgttttcgccgcacctcgtggagtctggttgaggcgtcaatggatcttggggccaatggctggcaaaccttccgctacgtagtgttgccgaatctcagttcggcgttactggctggaggaatgctggcgtttgccttgtcgttcgatgaaatcatcgtgacgacttttacggcaggtcatgaacgaacgttaccgttgtggttgctcaatcagcttgggcgaccgcgtgatgtaccggtaaccaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggagattgccgaggcatccgcagagcaggtcaatgctgctgttcgcgcggcagatgcagcatttgccgaatgggggcaaaccacgccaaaagcgcgtgcggaatgcctgctgaaactggctgatgttatcgaagaaaatggtcaggtttttgccgaactggagtcccgtaattgtggcaaaccgctgcatagtgcgttcaatgatgaaattccggcgattgtcgatgtctttcgctttttcgccggtgcggcgcgctgcctgaatggtctggcggcaggtgaatatcttgaaggtcatacttcgatgatccgtcgcgatccgttgggggtcgtggcttctatcgcaccgtggaattatccgctgatgatggctgcgtggaaactggctccggcgctggcggcagggaactgcgtagtgcttaaaccatcagaaattaccccgctgaccgcgttgaagttggcagagctggcgaaagatatcttcccggctggcgtgattaacgtgctgtttggcagaggcaaaacggtgggagatccgctgaccggacatcccaaagtgcggatggtgtcgctgacgggttctatcgccactggggaacacatcatcagccataccgcgccgtccattaagcgtactcatatggaacttggtggcaaagcgccagtgattgtttttgatgatgcggatattgaagcagtggtcgaaggtgtacgtacttttggctattacaatgccggacaggattgtactgcggcttgtcggatctacgcgcaaaaaggcatttacgatacgctggtggaaaaactcggtgctgcggtggcaacgttaaaatcgggttcgccggatgacgagtctacggagcttggacctttaagctcgctggcgcatctcgaacgcgtcagcaaggcggtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccggtagtgagtgttacgctcttcgacaacgaagaacaggtggtgaactgggcgaatgacagtcagtacggacttgcatcttcggtatggacgaaggatgtgggcagggcgcatcgcgtcagcgcgcggctgcaatatggttgtacctgggtcaatacccatttcatgctggtaagtgaaatgccgcacggtgggcagaaactttctggttacggcaaggatatgtcactttatgggctggaggattacactgtcgtccgccacgtcatggttaaacattaaggataatattgcagatcgtaagagtatgagatgatcttgcgtactgtcagagcactgatttctctgacagtacgtgctgcgtgcaaaatcactacatcaaataaaccagccaaatctcatagagataagagtaaacaaaccaacagcagcaaagacatttatcagtactacagttctactggaaacattcatttttgccaccttttatcattgcccctatgtgtatagtacgggttaagaaaatccgcaataatactcattctgaagatggataagggcaagttgctgtttgatgattttttctcaaactggtgaaaaaacttgatgcacgtcaaaaaatgacgcatatttgcgcgcgttttattcatctggctggacgcccgtacatgtctctctatcaacacatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttctctgttttaaatcttacgcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcagcgtttgcgcaccgctattgctcatcacggtcgcaaacataaagaagatatggaagcgcgccacgaacagttaaccaaaggcggtaccatcctctgattaaaatgagcgtctggccaccagccaggcgccaaccacaagtaaaattgcgccacaaattgggccgatcaacgcccgaagtggtacgccatggctgcggaagatatccagcaccagaccgccaatcagctggctggcgaccagtactgcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggactaccagaccaatcccggctgcaatcaaaaaggcaagggtaagtgactgattcatccaatcgcgtccggttcagtgcgctcgtcgagttgcaactgcataaatgtcagatccagccagcgcccaaatttagtacctacctgcggcatttgcgcggtgacgacaaatcccagcgactggtgaagatgcagcgaggcctgattttgcgattcgatcccggcgaccatgacatgcttcccgcaatcccgcgcttcatcaatcaatcggcttaacaatttacgccccagacctttcccctgatgatcgggatggacataaaccgaatgttccacggtatggcgaaaaccatcaaaactacgccagtcgccaaacgaggcatatcccgtcactacgccatcttcttcactcaccagcaccggataacctgctatggtccgcgcttcaaaccaggcaatgcggttatccgcatccaccgtttggtcattccagatagccgccgtatacaacacggcgtggttataaatttccgcaattgcagcacagtcggctttgcgggcaaaacggatggacatgtctggcctcgataaaataatgatgatgatgttatcaatactatcgaaaacagcccgaagcaacggattcctctatgaaattattgcgtgttgcagaggggatgtgacggctgcaaacaaaaccaatcctgtgagcctgctactattgatggattcatgccaaaagcacaggagagcattatggggcaacaaacgcagcgtaaccgatgttgggttctgtccttgcgtccgcatggcgcgccggttccttacgtctggtttcggtaaatgcgctctttgtcgcaccagcgcaagcatttacagttccggaagtgggaaaacgtcaattaaatgaaatcaatcggatccgctacgaactggaattaatggcagttgctctggctgtcgaaaacctcactatgcaaaaaaacgttgctttgttgtgccaacaatacagccgataaataaaatacgcccggcaaataccgggcttaaagataattactcaaatcgccacgcaatatttatgccgacaccataatttcgtccgggcgcaggttcgtaatatcgcccgtttgactcattgacaatgacagagccaacgtattctttatcgaataaattatcgacacgaccaaataaatccacggtaaaattgtggtaattgtatttatacccggtgaataagccgacgagtgtataagaaggcgctttggccgtattttcatcatctgccataatatcgcccatataacgcgcttccgtgcctgcataccaaccatcttccggtatataacctatcgacgcaaaggccatattacgggcgatccctggcatccggttaccgttacaatcctgttcattgcaaacattgctgcgataggtcgcatcaagccaggtccaggacgcttttacgcgaaaatctcccgcgaaacgttgatcccatgccagttcagcgccttgacgacgggtctttccggcatttttgtaagtcgtacgcccaccgctactgctatcgacaacaatttcatcatcggtgtcggtctggaacaatgcgagactaagcagcccatcaccaatacgcgttttactgccgatctcaattgtatcgttggtggagggttttaaaccaaagttcataccgctttgcccatcagcgcgataagacagttcattaatcgtcggcgtttcaaaaccgcgcccggctgccagatagacattccaggcatcggtcattgcatattttaacgatccggctggtagccatttgtgataactggcatcaccgctgtcgtcgccgttacccggagtaacgtaatgatcattggaatcaaaccacacagagctgtagcgcacgccagcatccagcgaaagtttgtcggtcagttgccactgggtttgtaaatagggatcgacgttccacatcaaattgcgttcgtcgcggcgcaactcacctttttgcccgtattccggcacgccgcgattcaggcggaagttattgtaacccttgcggttttcactcatgttttcgtagttcaggccggttgtgaacgtgactggaacgcccaattcaccacgctgtgtccagcggctgtctatcccttggtaatggcgttgcagggtaatcacgccgcccgcatgtgacgggttaagttgcggagccatggggattgactggtactgggtcgtttctcgctctccggcatacatcattacactcatatcatcttgcgcgctcaggctacgttcatagcgcaacccagcctgagtttgcttgatggtttttcgcgtgtcgtactgttctgcacgaggcgcttgttgtggattcgccttccattctgcttcggttagcccacctgggtcatctgctttgatatccacactattgaaaatcaggcttaatttgctggcgtcatcaatgcgtacgcccagtttggcattggctaaatttttctgtgcgccgctatggtcacgatagccgtgggtcgtaaaacgtgtggttgagacggtgtaatcgacatcgccgggttgtgtgccgtcgcccgttgcgcccgtagctttcagcccatagcgccagctgccaaaactgccgtagtaactactggcttcaatggttggtggctgttgtccggtctgggtggtgacattcattacaccgccagacgcgttgccatacagagcagagaaggggccacgcagcacttccacattttgcacactgcttaaatcgatgttagatgtttgcccttgtccgtcgggcatggtagcgggaataccgtccacatacaggcgaataccgcgaattccgtaagtagagcgggagccaaatccgcgaatcgacagctgtaaatcttgcgcatagttctgccggttttgtacctgtaaaccaggcactccggtcagtgattcagacaagttaatgcgcggtgttgccaggcgcatctcctcgccatccaccacgctcacggctgctggggtatccagttctgaaaccacctgcggtgcggcactgacaatcatggtctgttcatcagcggcaaaaacaacgggggaaaggacaagcagtgcgggcaaaacggtctgtcggacggaaaaaatcttcatgaaaaaagccaggttaagaatgggaaaacaccgtcatggtaatgaaattgtaaatttatggaaaactaaacggcacaatacgttaagtaattgagaaaattgtagtcgtaacggtaagaaatgctccacatttgagaaaataatgattaccattcccatttataacaagggcgtaacgatgattacgcttagcgaagcattgtgaagcagcaaaaatatcggttcatcaaagggagtcgtcatgcatttacgtcatctgttttcatcgcgcctgcgtggttcattactgttaggttcattgcttgttgcttcatcattcagtacgcaggccgcagaagaaatgctgcgtaaagcggtaggtaaaggtgcctacgaaatggcttatagccagcaagaaaacgcgctgtggcttgccacttcgcaaagccgcaaactggataaaggcggcgtggtttatcgtcttgatccggttactctggaagtgacgcaggcgatccataacgatctcaagccgtttggtgccaccatcaataacacgactcagacgttgtggtttggtaacaccgtaaatagtgcggtcacggcgatagatgccaaaacgggcgaagtgaaaggtcgtctggtgctggatgatcgtaagcgcacggaagaggtacgcccgttgcaaccacgtgagctggtagctgatgatgccacgaacaccgtttacatcagtggtattggtaaagagagcgtgatttgggtcgttgatggcgagaatatcaaactgaaaaccgccattcagaacaccggtaaaatgagtaccggtctggcgctggatagcaaaggcaaacgtctttacaccactaacgctgacggcgaattgattaccatcgacaccgccgacaataaaatcctcagccgtaaaaagctgctggatgacggcaaagagcacttctttattaacatcagccttgataccgccaatgagcgtgcatttatcaccgattctaaagcggcagaagtgttagtggtcgatacccgtaatggcaatattctggcgaaggttgcggcaccggaatcactggctgtgctgtttaacccagcgcgtaatgaagcctacgtgacgcatcgtcaggcaggtaaagtcagtgtgattgacgcgaaaagctataaagtggtgaaaacgttcgatacgccgactcatccgaacagcctggcgctgtctgccgatggcaaaacgctgtatgtcagtgtgaaacaaaaatccactaaacagcaggaagctacccagccggacgatgtgattcgtattgcgctgtaatagatatggcgagggtgaaaacggaaagaattacatgacttttatcacgccgcatccggcaccttcgtcagtagtctgaatttgcccggcacgtagccgggcaattttgcaattaactcgatgtttcaggcttaaacacaatttcctgtttttcttcatcttccgcgacgactggcgcagtgctgtgaatttcagcaacgcgtttgcgcacaccaaaccagcctataaccagcagaataccgataatcggcagtgccgcgatggtataagtcccgttcgggtaatcgaacgccatcagcaccaggacactcagtaaaaacagtaatgtcagccaggaagtgaagggcgcgccaggcagtttaaaactgacatccgctgctttgccttctttaatcgctttacgcaggcgcatctggcaaacgatgataaacgcccatgaagcgatgattcccagcgacgcgaagttcaacacaatctcaaatacgcgtgacggcaccagatagttgaggaatacgccgacgacatacacaaccagtgtcgccagaatcccggcatacggcacatgctgacgactcattttcgccataaaactcggtgcggaaccgcccatcgccatcgagcgcagaatacgcccggtgcagtacagacctgaattcaggctggagagggcagcggtcagcaccacaatgttcataatgctgccgatgtacggcacacccagtttagagaaaaacgtcacgaacggactttgccccgcctgatacgcgctccacggcaataacataaccagcaacaccacggagccgacgtaaaacagaccaatacgccaaatcacactgttaatcgctttaggcaccatggtctgcggatctttacattctccggccgctgtacccaccatttcaatggaggcaaaagcaaacactacgccctgaatcaacaccagcgcaggcagcaaaccgtgggggaagaagccgccattatcggtgattaaatgaaagccagtggtgttgccatccagcggctgaccactaccgaggaacactgtacccacgaccaaaaaggttacaatggcgagcactttaataagcgcaaaccagaactccatctccgcaaaccatttcacaccgatcatattcatggtgccaacgatggtcagtgcagcgagcgcaaagacccactgcggcacgccgccaaacgcgccccagtaatgcatatacagagcgacggcggtaatatcaacaatccccgtcatcgcccagttgatgaagtacatccagccagcaacataagcggccttctcacccaaaaactcacgggcataagagacaaaactgccactggaagggcggtgtaacaccagctcacccaatgcacgcagaataaaaaacgaaaacaggccgcagatcaaatagaccagtgccagtgcgggccccgccatttgcagtcgcgcccccgcgcctaaaaacaaacccgtaccaatcgcgccgccaatggcgatcatctgtacctggcgattgcccatcgctttgtgatacccctcttcgtgggcattaagccagcggcgtttcgcggcgtgttgatctgaagtgtcggtgttgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggatttatacaactgacgaaaaaatgataaatccttttgctggataacctgtgtgctgtcctacacttaatctttaaaagattgtgaggggcatatgattaaggtgtatggcgtacccggctggggctctacaatcagtgagctgatgctaacactggctgatattccttatcagttcgttgatgtcagtggttttgaccacgagggaacttcacgcgatttattaaaaaccctgaatccgttgtgtcaggttccgacactggcgctgtaaaaataacgagattatgacggagacagcggcgattgcattgatggttctcgatcgtcgcccggaccttgcgccacctcttgggcgcgccgaacgtcaacagtttcaacggctattggtctggctggttgctaatgtctatccaacgttcactttcgccgattaccctaagcgttgggcatctgacgcacctgtaattgaatatcgcaaatcgctttatatctggctgaattcgcaattgactgctgaaccgtatgtgtttggagagcaactaacgctggtggactgttatctctgcaccatgcgcacatggggaccgggacacgaatggtttcaggataatgccccgaacattaatgcgattgctgatgctgtatgtcagataccgaaattacaagaagtattaaaaaggaatgtcattatttaacaataatgccggaggttaatgttaatgaatcactggcgtagttaactggacgtccatttgtttgctatgaatagcaattaatgttggcacaactattcatatggttgatgtgatttcggtttttatattaaatatcaatttaatataatctgaaaataaaacatcttttcgcatgtagagaaacatgtcgatatgatagcgcagtgcagatcatgttatcagggctgggcggtagcgtatttaatcagggaaagattacgtaacactgcttttttgtactggacgattctcattttatgtttaaaaattgagatactccttatttcctgaaactgtttttcattgcttatacatgatcaaatactccttacataattaaggagaacaaaatgaaacttaatacacgccaacaatttgtattacttaaatagaccagtgaaggtacgtatcagaatatccggtgaagtgattaatatttcgttgaatatttctccggatttttgaaacctgctgctgtagaaattctgaacaggaggaattatgcctttagcagccaaacttaccgacaaaggcacccagcacgacggttattacgagaccgtcatcaccgccgggtcatccaccgtttttatcgatggtctccccgcagcccgtcagggagatccgctgacgccgcatgctaaaccgaagcatccacctcatccccgaaaaatcgccagaggctcgtcaaccgtctttattgacggcctgcccgccgccagaaccggtgatgctattgactgcggcggcgtggttattggtggcggcacggtaaatataggctgatatgtctgagaggtatttatgtccttaaaaggtcttcgctttacgctggaggttgacggccaggagccggaccccctccatcgggcagtttcccagacattactcacccgtccgccactcgtcagcaaagcagcaagctgctttctgttaccgttcgacttgcatgtgttaggcctgccgccagcgttcaatctgagccatgatcaaactcttcaatttaaaagtttgatgctcaaagaattaaacttcgtaatgaattacgtgttcactcttgagacttggtattcatttttcgtcttgcgacgttaagaatccgtatcttcgagtgcccacacagattgtctgataaattgttaaagagcagttgcgacgcggctttcagctcactgtcgcgaggtggcgtatattacgctttcctctttcagagtcaaccctgaatttcaggatttttctcttcaaccgaaccggctgtttgtgtgaagtgattcacatccgccgtgtcgatggaggcgcattatagggagtcgtctcaggaagacaagcggaaaaatgcatttttatttcaacagctcatcttttaatcattacgccggtttttgctgcttttttatcgcttgcggcaggtctgccaggctatttaacacccaatccgccgcgttttctgcttcaggcgtaataggtttacccgtacgcaccagcacttttgttcccacgctcgccgcagccgctgcctgcatatcttctaatttatcgcccaccatataagaagcggccatatcaatatgcaaataatcgcgtgctgacaaaaacatccccggatgtggtttgcggcagtcgcagacctggcgaaactcttcaacactaccctgcggatgatgcgggcaataatagataccatccagatcgacatcgcggtccgccagcgaccagtccatccactcggtcagcgtttcaaactgtgcttcagtaaatttaccgcgagcaatgccagactggttggttactaccaccagcgcaaagcccattttttttagctcgcgcatggcgtcaataacaccgtcgataaattcaaagttgtcgatctcatggacatagccgtgatcgacattaatggtgccatcacggtcaagaaaaattgcgggtacgctcttcgccaccttttatagctccttaataaggcatgtgacgctagtatcgcatgtttcgacctgcaagaaagtgctcttcgcataaacctgattgatttagacgtctggatgccttaacatccatttcattgacggcgttgcccgttccaggcattcgaaatgccacgactaacttaatgacgataataaataatcaatgataaaactttcgaatatcaccaaagtgttccaccagggcacccgcaccatccaggcgttgaacaacgtcagcctgcatgtgccagctggacaaatttatggcgttatcggtgcctcaggcgcgggtaagagtacgcttatacgttgtgtaaacctgctggagcgcccaaccgagggtagcgtgctggtcgatggccaggaactgaccacgctgtcagaatccgagttgaccaaagctcgtcgccagattggtatgattttccagcattttaacctgctctcttcgcgtactgtttttggcaacgtggctctgccgctggagctggacaacacaccgaaagacgagatcaaacgtcgcgtgacggaattgctgtcattggttggtcttggcgataagcatgatagctacccgtcgaatctttccggtgggcagaaacaacgtgtggcgattgcccgtgcattagccagcaatcccaaagtattgctgtgtgatgaagccaccagcgcgctggacccggcaacgacacgttctattctcgaactgctgaaagacatcaaccgccgtctgggtttgacgattctgttgatcactcacgaaatggacgttgtgaagcgcatttgtgattgcgtggcggtcatcagcaatggcgaactgatcgagcaggacacggtaagtgaagtgttctcgcatccgaaaacgccgctggcgcagaagtttattcagtcgaccctgcatctggatatcccggaagattaccaggaacgtctgcaagcggagccattcgctgactgcgtgccgatgctgcgtctggagtttaccggtcaatcggtcgatgccccactgctttctgaaaccgcgcgtcgtttcaacgtcaacaacaacattattagcgcgcagatggattacgccggtggcgttaagttcggcattatgctgactgaaatgcacggcacacaacaagatacgcaagccgccattgcctggctgcaggaacaccatgtaaaagtagaggtactgggttatgtctgagccgatgatgtggctgctggttcgtggcgtatgggaaacgctggcaatgaccttcgtatccggtttttttggctttgtgattggtctgccggttggcgttctgctttatgtcacgcgtccggggcaaattattgctaacgcgaagttgtatcgtaccatttctgcgattgtgaacattttccgttccatcccgttcattatcttgctggtatggatgattccgtttacccgcgttattgtcggtacatcgattggattgcaggcagcgattgttccgttaaccgttggtgcagcaccgtttattgcccgtatggtcgagaacgctcttctggagatcccaaccgggttaattgaagcttcccgcgcaatgggtgccacgccaatgcagatcgtccgtaaagtgctgttaccggaagcgttgccgggtctggtgaatgcggcaactattaccctgattaccctggttggttattccgcgatgggtggtgcagtcggtgccggtggtttaggtcagattggctatcagtatggctacatcggctacaacgcgacggtgatgaatacggtactggtattgctggtcattctggtttatttaattcagttcgcaggcgaccgcatcgtccgggctgtcactcgcaagtaacgttcaacacaacataaataattgaagaaggaataaggtatggcgttcaaattcaaaacctttgcggcagtgggagccctgattggatcactggcactggtaggctgcggtcaggatgaaaaagatccaaaccacattaaagtcggcgtgattgttggtgccgaacagcaggttgcagaagtcgcgcagaaagtcgcgaaagacaaatatggcctggacgttgagctggtcaccttcaacgactatgttctgccaaacgaagcattgagcaaaggcgatatcgacgccaacgccttccagcataaaccgtaccttgatcagcaactgaaagatcgtggctacaaactggtcgcagtaggcaacacttttgtttatccgattgctggttactccaagaaaatcaaatcactggatgaactgcaggatggttcgcaggttgccgtgccaaacgacccaactaaccttggtcgttcactgctgctgctgcaaaaagtgggcttgatcaaactgaaagatggcgttggcctgctgccgaccgttcttgatgttgttgagaacccaaaaaatctgaaaattgttgaactggaagcaccgcagctgccgcgctctctggacgacgcgcaaatcgctctggcagttatcaataccacctatgccagccagattggcctgactccagcgaaagacggtatctttgtcgaagataaagagtccccgtacgtaaacctgatcgtaacgcgtgaagacaacaaagacgccgaaaacgtgaagaaattcgttcaggcttatcagtctgacgaagtttacgaagcagcaaacaaagtgtttaacggcggcgctgttaaaggctggtaatatttaggctgtttccacaatttgtaatatcattcaggacgggcgcttgcccgtcttgtcatttttacaagcgcctgattcaatattgacgtgttgatcatacattgaggaaatactatgcgtgctttaccgatctgtttagtagcactcatgctaagcggctgttccatgttaagcagatcccctgtcgaacccgttcaaagcactgcaccccagccgaaagcggagcctgcaaaaccgaaagcgccgcgcgccacgtcggtccgaatttataccaatgcagaagaattagtcggcaaaccgttccgcgatctcggtgaagtcagtggcgactcttgccaggcctctaatcaggactctccgccgagcattccaaccgcacgtaagcggatgcaaatcaacgcctcgaaaatgaaagccaatgcggtattactgcatagctgcgaagtcaccagcggtacgccaggttgctatcgtcaggctgtatgtatcggttctgcgcttaacatcacggcgaaatgagcagtttccagttcgagcaaataggcgttattcgctcgccctataaagaaaaattcgccgttccgcgccagccaggtctggtaaaaagcgccaacggcgaactacatctcattgctccctacaaccaggccgacgccgttcgcggcctggaagcattcagccatttatggatccttttcgtctttcatcaaacgatggaaggcggctggcgtccgactgtgcgtccgcctcgtctcggcggtaatgccagaatgggtgttttcgctacgcgctccacttttcgccctaacccgattggtatgtcgctggtagagctgaaagaggttgtttgccataaagatagcgtgattctgaagctcggcagtctggatctggtcgatggtacgccggtagtggatatcaaaccgtatctcccctttgctgaatcgcttcccgatgccagtgccagctatgcgcaaagtgcgccagcggcagaaatggcggtgtgttttaccgcagaggtcgaaaagcagcttttgacgctgaagaagcgttatccgcagttaacgctgtttatccgcgaagtactggcgcaggacccgcgcccggcctatcgtaaaggtgaggaaacgggcaaaacctatgccgtctggctgcatgattttaacgttcgctggcgcgtcaccgacgcaggttttgaagtctttgcgctggaaccgcgttaaattcacgcccttctcttttgacatttcttttgcactggtaaactaaatcactttttttgtcccaggctcgccttgagcctgttctaccttccaactggaaccgtaacaacatgcgtactagccaatacctgctctccactctcaaggagacacctgccgacgccgaggtgatcagccatcagctgatgctgcgcgccgggatgatccgcaagctggcctccgggttatatacctggctgccgaccggcgtgcgcgttctgaaaaaagtcgaaaacatcgtgcgtgaagagatgaacaacgccggtgcgatcgaggtgttaatgccggtggttcagccatctgaactgtggcaagagagtggtcgttgggaacagtatggcccggaattgctgcgtattgctgaccgtggtgaccgtccgttcgtactcggcccaactcatgaagaagtgattacagacctgattcgtaacgagctgagctcttacaaacagctgccgctgaacttctatcagatccagaccaagttccgcgacgaagtgcgtccgcgttttggcgtcatgcgttcccgcgaattcctgatgaaagatgcttactctttccatacttctcaggaatccctgcaggaaacctacgatgcaatgtatgcggcctacagcaaaatcttcagccgcatggggctggatttccgcgccgtacaggccgataccggttctatcggcggtagcgcctctcacgaatttcaggtgctggcgcagagcggtgaagacgatgtggtcttctccgatacttctgactatgcagcgaacattgaactggcagaagctatcgcgccgaaagaaccgcgcgctgctgctacccaggaaatgacgctggttgatacgccgaacgcgaaaaccatcgcggaactggttgaacagttcaatctgccgattgagaaaacggttaagactctgctggttaaagccgttgaaggcagtagcttcccgctggttgcgctgctggtgcgcggtgaccacgagctgaacgaagttaaagcagaaaaactgccgcaggttgccagcccgctgacttttgcgaccgaagaagaaattcgtgccgtggttaaagccggtccgggttcactgggtccagtaaacatgccgattccggtggtgattgaccgtaccgttgcggcgatgagtgatttcgctgctggtgctaacatcgatggtaaacactacttcggtatcaactgggatcgcgatgtcgctaccccggaaattgctgatatccgcaacgtggtggctggcgatccaagcccggatggtcagggtacgctgctgatcaaacgtggtatcgaagtcggtcacatcttccagctgggtaccaagtactccgaagcactgaaagcctccgtacagggtgaagatggccgtaaccaaatcctgacgatgggttgctacggtatcggcgtaacgcgtgtggtagcagcggcgattgagcagaactacgacgaacgcggcatcgtatggcctgacgctatcgcgccgttccaggtggcgattctgccaatgaacatgcacaaatccttccgcgtacaggaacttgctgagaaactgtacagcgaactgcgcgcacaaggtatcgaagtgctgctggatgaccgcaaagagcgtccgggcgtgatgtttgctgatatggaactgatcggtattccgcacactattgtgctgggcgaccgtaacctcgacaacgatgatatcgaatataaatatcgtcgtaacggcgagaaacagttaattaagactggtgacatcgtcgattatctggtgaaacagattaaaggctgatgccagaaagggtcctgaatttcggggcccttttttacatggattgtataaaatggataaaccaaaggcgtactgccgcctgcttctcccctgctttcttttactttcggcctgtaccgttgatatcagccagccagactcatcagccacagtggtaaatgccgaggcgaaaacatgggctgttaaattccagcatcaaagctctttcaccgaacaatcaataaaagaaataacggaaccagatctcaaacccggcgatttgcttttctcctcaagccttggggtaacctcatttggtatccgcgtattcagcacttcctctgtgagtcacgttgcaatctatttgggagataacaacgttgccgaagcgacaggcgctggcgtccagattgtttcccttaaaaaagccataaagcatagtgataagcttttcgtcttacgagtcccggatcttaccccgcaacaagccacagaaatcaccgcgttcgccaacaaaattaaagatagcggttacaactatcgcggcattgtcgaatttattccatttatggtgactcgccagatgtgctcactaaatccgttctccgaggattttcgtcaacagtgcgtcagcggcctggcgaaagcgcagttaagcagtgtgggcgaaggagacaaaaagtcgtggttttgttcggaatttgtcactgatgcatttgccaaagccgggcatccgcttacgctggcgcaatcaggctggattagccctgccgatctgatgcatatgcgtactggcgatatctctgcgtttaagccagaaacgcagttacagtatgttgggcacatgaagcctgggatttatatcaaggcaggccgctttgttgggctgactcagtgataaaagccagcctcgtgcgcaaaatgccggatgcggcgtgaacgccttatccggcctacaaaattgtgctaattcaaaatattgcattgtatgctttaggcctgataagcgcagcgcatgaggcaatatttcatttgtttctgtctcaagacgggttacagccccaaactactgcaatcctggtttgggtaaaatttacctgccgtatcgggcgctaatactttggtcggcgcaccggtatccggattagcctcaagcgtaaagtgaccttctactgacagtaacaccggtttttcactgttaccgcgcgcagccaggtagccacgctccagctctgcgttattcgccaccatgaaacgttttccggtcgcgcaatcagtgaaggtcgccgcatcagccatataaaaatacatgccccgcagggtcatcggcgtcatgggtaagctggattgtgccggttccagcgtgtagttgaactgcgattcaatcggattaccttcacgatcgagcatctccagcgcatctcctttcgcgcgataatatgacttttcacctttgctatcggttaataccagcttgtcagcggttcgcgcccatgtaccgtaggaagcgaaggaggaaggttcttcacgagcccccagataacgctcattcatcacccaggttccgtctttttcgaggaacagagaggtttcgattccttcgcaatcagcacacggcagcacgccacgccaactttgcggcatcggtttcagttcggcagcctgcgccggagaaagcgtatcgacttcggcccgattattacatcccatcagagtaaagaggctgattacagccatcgctgtcactatcgcttttttcaccatccattccttctttttattccagaccgctgcgcactttgccgcgcatcgccttcacgcttgatttttgtgctttcgatgccagcctgcgctcttttgatgcacgggtgggccgcgtaggtcgtcgggctttttgttctgttgttaaatctttaatcactgccaccagccgggccagcgccgcttcgcggttcagttcctgactgcggtattcctgtgccttaatgacaatcactccgtcactgctgatcaaatgatggctggcggcgagcagacgctctttgtaatactctggcaggctggacgcccgaatgtcaaaacgcagatgaatagccgttgaggtcttattaacatgctgcccgcccgcgccctgcgcacgaatggcggtgatctcaaactcgccatcagggatagcaacatgtcgggaaatcacaatcatgaaggttgttgccagacggttaagttcacttccagattattcttatcatccgataaccagataacaccatcctgaatcgttgcctgcagcgtcatagtacgatcggcaaaggcgctcactttcgccagctgctcgtcgtccagataccagacggaaagattggcaaactgcgcacatttgctctgattttgctgccaccagatttgcgccgcccgactattataggcaaacagcgccacttctgcggcctgggtgcaggctttcttaatccgtcgctcatccggcagccccagctcaatccacaaatcaatgcccaggtgatcgttacgcagccacgcttccggctcatcatcggcacacaaaccacgggtaaattgcagacgttcatcggcatattttagccacgccagcaggcgcagcatcatgcgctcctgggtttctgaaggatggcgcgccagcgtcagagaggcatcgagaaactggttgcggtcgagatcggccacattaaccgtcgctttataaattgtcgctttaagcgccataagaaaactcctttcgaatcaggaggccattgtaacggaatacgtgcagttgcggcgctgatattgcagaaatgagtgtggtatagtcaccttgcgaaacagagtttatcttcgtaggcttagacttgcatccacggttaagtcagagtgctgacaggagggcatgtggaaaaatattgtgagttaatacgcaagcggtacgcggaaatcgccagcggagacttaggatacgttccggacgcgctgggctgcgttttgaaagtgctgaatgaaatggctgccgacgacgccctttctgaggctgtcagggaaaaagcagcatacgctgcggcaaacttactggtgagcgattatgtcaatgaatgatacgtatcaaccaatcaattgtgatgattacgataatcttgagctcgcctgccagcatcatttaatgctgacacttgagctgaaagatggcgaaaaattgcaggcgaaggccagcgatttagtctcccgcaaaaatgtggagtatctggtcgtcgaggccgctggtgcaacccgcgagctgcgtctggataaaattaccagctttagccacccggaaatcggtacggtggtggtgagcgagtcctgattgactttcgccggatgcgacgtttgatgcgtcttatccggctttcacttgactaagcgttttctgccagacaaaactgacgccattctcacctacagccacaccttcttgcgtcacaaatacccctgccgccgcaatcagcgtttcgccataaaacagcagtggcgtggtatcacgtagccacggcggaacgcctaactcttgccagattttcttcagcttacgtccgccgttgcgcccgacaatatgcagcagtcctggcgctttgaaacgcacgctgaccgcttcatctgcacgcggagggcgaatatcgcctcccgcagtaagctgtacacttcccagccccgccggtaattccagcggttgtagccacgtctgccacggcacaatggtttcgctttgcccggcaacggatttaatccaccatagttgcgactgatagcggcggatttcaaacgcgcccaaacgtaaacagggggaggcatcttcccgcgccagcgccacttcctgccagatcctcaccaacgcgtcgcgggaaggcatcggtgcattctgccctgctagccagcggcggataatcgccgcgcgacgggcatcactcatcgccagcattggcgcaatctgcagcgtcccctgcggagtttgacagtgcgctaaatcatccgccagcagttcatctaacaggctctcttgttcagcacaaagtgcggcgctgcgggctgttgcttcggcaaaatgcggccaacgctgctgcaataacggcactacgcgcaggcgcagaaagttacgatcgtagctatcatcctgattactttcgtcttcaatccagcgtaaaccatgcgccaacgcccactgcaccagttctccccgcgtgcgggcaagcaacgggcggataagctgtgttccggcaaactccgaaacttccgccatagccgaaagcccggcagggccgctaccgcgttttagcgccagcagaaaggtttcacattgatcgtcgagatgttgcgctgtaaccagcacttcaccgggcaacaaggtgcgggcaaatgcctgataacgtgcctgccgcgcctgggcctcaatacctagcccctcttgcgcaagctgcacacgttcgaccaccagcggcacctgccactgttggcagatgttttcacaatgtttcacccatgcatcagcattggcgcttaaaccgtgatgcacatggatagcgcgcagagtgacgcccggattttccgtccgccactgcaccagttgatgcagtaagacagtagaatcaaggccgccgctaaaggccaccagaatctggcgtgaggagagaagttgtctattgagcgtgagtgtcatgatggtgcgattttacagtagcaatgccgggcacgttaccgggcaaatgcggcgatgacaagccttactgctcatacagttccaacggcagcccgtccggatcgttaaagaacgtgaagcgtttttgcgtgtagggatcgacacggatggcttcacacttcacgttatggctttcaaggtgcgccactgccgcatcgatatcatcaacgctaaaagccagatgacgcaggccgcaagcttccggtcggctggggcgctccggcgggaacggaaatgagaaaagctcaatcacatattgtccattaagcgccaaatcccctttccacgagtcgcgcgcttcgcgatagacttcgctttgcagcgtgaaaccaagaatatcgcagtagaaagctttgctcatcgcataatccgtcgcaataatcgcaatatggtgaacctgttttaaacccagcataacgtctcctttatttgttaacagcacgttactcgcccggaagccgctctggcaagttatcctgccatttttaggactcgtacgcggtaaacaccgtcttcgtcctgtttcgcgccgtgaatatccgtttcaaaaccggggtaatgttgccctacggaacaaagcatcagtagaaaatcgagtaccgtgcggctctcttcggtaagcatttctcccggcatcagcagcggtacgccgggtggataaggcaggatcatatttgccgatactctaccgaccagttgttccagcgcaatggtttctacttcgcctttaatctgtctctgccatgcctgatgtggcgtcatgatcatctcctgcaaggtatcaaatgcccgcaacatcaaaccgggaagatcgtgtttacgaatcagcttatggatcccttgcgccagatcctgaatacgcatattgcggtagaaatcgggatcttctgcatagagatcgggcagcatatttttgatccgcaggttgagatcgtaagagcgcttaaattccgtcaacccacgcaataatcccattgctttggttttatcgatgccaatactaaagagaaacagcaggttataagggccggttttctctactacgatcccacgttcgtcgaggaattttgccaccagcgccgccgggatcccctcctcgctcatattgccctgctcgtccatccccggtgtcaaaatagtgactttaaccggatcgagaaacatgtgattggcatccgcatcgctaaagccgtgccactgttcgccaggcgcaacgggccagcattcggcttcatccacctgcggcggttgccagatatcgaaaaaccagccgtcagactcttcccgcagccgctggacctctttgcgaaaatgcagagctcgttctactgaacggttaatcagccgtttgcccggattaccacgcaacatcgccgccgccgtctcaacagaagcaacaatgggataactgggcgaggtggtggtatgcatcataaaggcttcgttaaacgcctcttcgtcatactcacctttaatgtggatcagcgacgcctgcgataacgccgccagcattttgtgggtcgactgcgtttcgaagatcacttttcctgcaacacgctcgccgctcataccacttttaccctggtagattggatgaaaatgggtgtacggcacccaggcagaatcgaagtgaatcgacgggacatccagcgtctgtttgatccagtcggtgttgtagagcaagccatcataggtggagttggtgatcaccgcatgaaccggccattgtgcctgcgtggtggcagcgactttctcttcgatgctgtcgcgagtaaattcacggcgcgggatcccacccagaatccccaacgcattacgcgtcggtttcagccagactggcactacatcgttcatcatcaacagatgcgccagcgatttatgacaattgcggtcgatcaacagcgtactgccgaatggcgcggcgtacatacccacaattttgttcgacgtcgatgttccgttggtaacgatataactctgttccgcgccaaacgtccgcgcgatgtactcttccgcttccaggtgtggcccggtgtggtcgagcaacgaaccaagctcggtgaccgaaatagagacgtccgccttgagggtattcccgccgaaaaaatcataaaacagacagccaaccgggcttttttgatatgcggtgccgcccatatgccccggcgtacaaaaggtgtacttccgctctttgacgtaggtaaacaaggctttcgtgaacggcggcgtaatgttatcaagatattcgttggtgtactgacgcatacgaatggcgatatcttccgcctgccccagcgcatattcaaaaaaccagagcgccatccgcatatcctgcacgctgacatccatcgtcgagtgggtgttgatgaaggcataaagcgggagatattcattaagttgattgatatcgctacataaatcgagactgtactcatcccagtcaaaaatcacgccgcaaattcgtgggttatgttcgataaacttcagcaaatcaacgctgttttgtggccagataatctgaaagccttgcgccaccagcgccgactccagttctttgatgggctcatctttataaaagacgccatgcggtcccataatggcaatgatgttcatgtgttcctcctggaaaatccttccttaatcatagcctgctcaaaccgtggcgataaaaaagggccaccgaagtgacccttttcagaacatttgccgattacgcgtagccgtagctcatcaggcgctgataacgacgattttttaaatcttcagtgcttaacacgtcgagatcggccagatccgccagcagctgcgctttcagagacgccgccatcgcttccgggttacggtgagcaccgcccagcggttccgggatgatggagtcgatcagtttcagctctttcagacgcggagcgatgatacccatcgcttcagccgccagcggcgctttgtcagcgctcttccacagaatggatgcacaaccttccggcgagataacggaataggtgctgtattgcagcatattcactttatcgcccacgccaatcgccagcgcaccaccagaaccaccttcaccgataaccgtacaaactaccggtacgccgaggcgagacatttcacgcaggttgcgtgcaatggcttcagactgaccacgttcttctgcgcccacgcccggataagcccccggggtgtcgataaaggtgatgataggcatcttaaaacgttcagccatttgcatcagacgcagtgctttgcggtaaccttctggcgctggcataccaaagttacggcgaattttttctttggtttcacgacctttttgatgaccaatgatcatcaccggacgaccatcgagacgggcgataccaccgacgatagctttatcgtctgcatacgcgcggtcgccagccagttcgtcaaattcatcaaatgccaggcgaacgtaatccagggtataaggacgctgtggatggcgtgccagttgcgcaatctgccatgcaccgagatcggcgaagattttacgcgtcagttctacgcttttttcacgcagacgatgcacttcttcatcgatgttaatatccagtttctcatcctgacggctaaccgcggtcagagaatcgattttcgcttccagctctgcaatcggctgttcaaaatcaaggaaattcagactcatagtattcctgtattagtcaaactccagttccacctgctccgaaccaatgaggccacggagatcgtttaataaacgatcgctcggagagacacgccacgtcgcgccaaaacgcaatcgcgcgcgtgcatccgccctctgatagtagagatgtactggaattgtcccagagcggtggggttccagagactgacggagtcggtttaaaagctggtcatcaatttgcctgtccgtcagcgagatagcaagcccgcgagcatatttttcccgggcttcgtcaatatccatcacttcgcgagcggtcattttaagcccaccgctgaagtcatcaaagctgacctgtccgctgacgataagtatgcggtctttttccagcaattgctggtatttatccagggcgtcagtaaacaacatcacttccagccgcccggaacggtcatccagcgtgcagataccgatacgattgccgcgcttggtgaccataacccgcgcggcaacaacgagccccgcagccgtgatgactttaccacgttctgtcgggtgcatgtctttcagccttacgcctccgacataacgctcaatctcttttaaatactggttgatagggtgtcccgtgaggtacagacctaacgtttcacgttccccatctaacaccacctgctccggccacggttggcagctggcgtaggattgttcaatttgttccggctcttcggccagcacgccgaacatatcggcctgaccgatagcttccgctttcgcgtgttgatctgccgcttttaacgcatcgcccagcgagttcatcagcgccgcgcggtgtggcccaagacggtcaaacgccccggacatgatcagtttttccagcactcgccggtttaactttttggtgtcggtacgggcgcagagatcaaacagttcgcggaagtagccacctttattgcgggcttcgatgatggcctcaatcgggccttcacctacccctttgatcgcgccaataccatacacgatttcgccgtcgtcgttgacgtggaaatggtaaagaccggagtttatatctggtggcaggattttcagccccatccgccagcactcatccaccaggcccaccaccttctcggtattgtccatatcggcggtcattaccgccgccataaactccgccggatagtgcgctttcagccataacgtttgatatgacaccaaagcataggccgcagagtgcgatttgttaaatccgtaacccgcgaatttctccaccaggtcgaagattttcatcgccagttcggcgttgattccgttcttttctgcaccttcagcaaatacagaacgctgcttagccatctcttccggctttttcttacccatcgcacgacgcagcatatccgcgccaccgagggtataaccagaaagcacctgggcaatctgcatgacctgttcctgatacaggatgatgccgtaggttggctccagtaccggtttcaggctttcatgctgccactgcacgtccggataggagatctcttcgcgaccatgtttacggtcgataaagttatccaccatccctgattgcaacggaccggggcggaaaagtgccaccagtgcgatcatatcttcgaagcagtcaggttgcagacgcttgatcaggtctttcatgccgcgcgattcaagctggaataccgccgtggtttccgagcgttgcagcatgtcgaagcttttcttgtcatccagcgggatcgcggcgatatccagaggcggctcgccgttcttcgcccgccgcttgttgatcatctccagcgcccagttgatgatggtgagcgtacgcaaaccaaggaagtcgaacttcaccagtccggcgtattcaacgtcgcttttatcaaactgggtgaccggatgtttgccctcttcatcgcagtaaagcggcgcaaaatcggtaattttggtcggtgcgataaccaccccaccggcgtgcttaccggcgttacgggtgaccccttccagtttgcgcgccatgtcgatcagcgccttaacttcttcatccgcttcgtagatttccggcagctgcggctcggcttcaaacgctttcgccagcgtcatccccggatcgggcgggatcagtttcgagatacggtcgacaaagccgtacggatgccccagcacgcggcctacgtcgcggatcaccgctttcgccgccatcgtaccgaaggtgataatctgcgataccgcatcacgaccgtacatgtccgctacgtgctcgataacctggtcgcgtttctccatacagaagtcaacgtcgaagtcaggcatggagacacgttccgggttaaggaaacgttcgaacagcaggtcaaattccagcggatcgagatcggtgatttttaacgcgtaggccaccagtgaccctgcaccagaaccacggcctggccctaccggtacaccgttatctttcgaccactggataaattccataacgatgaggaagtaacccgggaagcccatctggttgataacctgaagttcagtatccagacgttcgtcatattccgggcggcgcttaagacgttcttcctcgtcagggaataaaaaggccagacgctcttccaggccctcttttgcacgcttgaccagataatcttcggtgctcatgtccccggtcgggaactgcggcaggaagtattcaccaaggcgcacggtcacgttacagcgtttggcgatctcaacggtgttggcaagggcttcggggatgtcggcaaacagctcacacatctcctcttcgctacgcatatattgctgcggcgaatagttacgagggcgtttaggatcgtcgagggtaaagccgtcgtggatcgcgacgcggatttcgtgtgcgtcaaagtcgctgctgtcgataaagcgcacatcgttagtcgccacgacgggcaaaccgcgcgcttccgccagttccaccgccgcgtgcagatagctttcttcatccggcctgccggtgcggatcagctcgagaaaatagcgatccgggaagtgttcttcataaaacgcgacacactcatctaccagcgcgctgttaccacgcaaaagactgcgtccaacgtcgcccatgcgcccgccggaaagaaggatcaacccttcatttaattcgataagccagtcgcgatcgatgatcggcccggcggtaccgtacccgcgctgatacgcttttgagatcagcaacgtcagattctgatagccggtattgttcgccgccagcaccgtcaggtgagttaactcatcacccagcaggtcgcactggacgttaaaatccgccccgacgatgggcttaatccctgcgccatgtcccgctccgtagaacttcaccagaccgcaaaggttggtgaaatcggtgatcgccagtgctggcatacccaacgctgccgccttttttaccagcggtgcggttttggccaggccatcgatcatcgagtagtcgctgtgcacccgcaggtgtacgaaacgtggttcagacatcttcagattccggtttacttaatctcgacacaagaatcaggacgcaagtcccagtgcgcgtttgacaggcccaaagctgcgccgatggtgttcggtcgcgccgtgttcagccagtttttccagatgaaaagcggttggataccctttgtgttgggcaaaaccatattgcgggaaaacaatatccagcgctgccatttcggcgtcacgcgtcactttcgccaggatagacgcggcactgatttccggtacgcggctatcgcctttcaccacagccatcgaaggcatcggtaatttcgggcagcggttaccatcaatcaacacatattccggcgcaatatgcagtccagcgacggcacgctgcatcgccagcatggtcgcatgtaaaatattcagttcgtcgatttcgtgaggttccgcgcggcccagactccagctcaacgctttctctttgatctcttcacagagcgccagacggcgtttttcgctcagctttttggaatcattcagcccggcaattgggcgcgccgggtcaaggatcaccgcagcggtgacgaccgcgccaactaacggcccgcgtccgacttcatccacccccgcaaccagctgcgtgtgcggatagacaaattcgatcattgtgctaactccagaacggcttgtgccgcctgctcatcggcattgcagcggatctgctgatgcagctcgcggaaggtgtcgtgcatcgcatggctggttttcccgttcgccaacagcggtaacagcgccgcagccaatttttgcggctcacactcttcctgcaatagctctttgactaactctctgcccgccagcagatttggcagcgagacataatcagttttcaccagtcgcttcgccagccagaaggtgaaaggcttcatgcgatatcccactaccatcgggcatttagccagcatacactccagtgctgccgtacccgacgccagtagcgccgcatcactggcgaccatcgcctcacggcccattccatccagcaaatgaaccgacaggtctggcgcgactgcagctttgatgcgttcaaactgctcgcggcgtttggcattcaccagcggcaccacgatttcgagatccggatatgtctggcgcaaaagctgggccgttttcaggaaatcggcactaagcatttcgacttctgcaccacggctgcccggcaacaatgccagacagtgggcatcgtaagggatccccagcacatcacgggcaccatttttatctggatctaatggcatggcatcagccatggtatgaccgataaagcggcacggaacgttgtatttgtcataaaacgctttttcgaaaggcagaaatgcgagcaccagatcggtggctctgcctattttgaaaacgcgtttctgtcgccacgcccagacggacgggctgacgtaatgaatggttttgataccctgctttttgaggttaccttcaagagtaatattgaagtcaggcgcatcaataccaacaaaaacatctggcttcagttcgccaaaacgctttgtcagatcggcacgaatatgtagtaagcgacgcagacgaccgagcacttcaacaatgcccatcactgccagttcttccatttcgtaccaggcttcgcagccttcagcctgcattcgtggcccggcaacaccaacaaagcgggcgttgggcacacgttctttcagagcgcggattaaaccggcccccaggatatcgccggaggtttctccggcgaccagggcaatcgttaatggacgctgttcagtcattaacgaatcagaccgcgcgttgagcgtgcaaagaaatcggtaaaggctttcacttccggatatgtttccgccagttcagcaatttccggtttcacttcatcgagcgttttaccgctacgataaatcagcttatacgcattgcggatagcggtaatcgcctcacggctgaatccgcggcgcttcagcccttcgatattgacaccgaacggcgttgcgtggttaccctgcgcaatgacataaggagggacgtcctgcgccacaccggagcagccgccaaccatcacatgcgcaccaatgatgcagaactgatggactgcggtcatgccgccgatgatcgcgaagtcgtcaaccgatacgtgacccgccagcgttgcgttgttggcgaggatgcagcggttacctaccgtacaatcgtgcgcaatgtgcgcattgatcatcagtaagttgtcgctgcccaccttcgtcaatccaccgccctggactgtgccacgatgaatggtgacgctttcgcgaatgcggttacgatcgccgatttccacgcgggtcggttcgccagcatatttcagatcctggttaacttcgccgatggaggcgaactgataaatctcattatcgcggccaattttagtatgaccattcacgacaacgtgagatttcagtacggtaccctcaccaatttcgacatggggtccaacgatacaaaaaggaccaatgtgagcgttcgcgccaatcgacgcgccctcttccacaatggcggttggatgcacaaaggcggatttatcaatcacgtatcaggcctcccggctacgagcacacatcatcgttgcttcgcaaactactttaccgtcgaccagagcaacccctttaaaacgggtcaggccgcggcgcgttttttcgaaagtgacttccatgatcatttgatcgccaggcacgaccgggcgcttaaagcgcgcttcgtcaataccggcgaagtagtacagctcacccggttccagttttcctacgcttttaaacgccagaatacctgttgcctgtgccattgcttccagaatcagcacacccgggaaaatcggttttccagggaaatggccctggaagaatggctcattgacagagacattttttactgcgcgcagaaaacgaccttcttcaaaatccagcacgcgatccaccagtaagaacgggaaacggtgcggcagaagttctaaaatctcttcaatctgcagagtatgagtgttagtagtcaagatactcttcctgtcaaaatataagaaacgacaataataacacggcctgccgcaatcgtaagaatgagacaggccgtaaagtttggcgaacaaaagatggaacgttagtcttgttgattaaccttgcgctcaagcgatttcagacgcttgctcatgtcatcaatgttcatcaccagtgcagcggttttgcgccagactttgttgggttgcagcggaatgcctgaggaatagacgcctggttcagtgatgggacgcatcaccatacccatgcccgtaaccgtcactttgtcgcatatttccatatgcccgttgattacgctggctccgccgatcatgcagtaacgaccaattttcaggctgcccgccataatgacgccaccggcaactgccgtattgtcgccaatcacgacgttatgtgcaatctggcactggttatcaatgatcacaccattgccaataacagtgtcatccagcgcgccacgatcaatagtagtgcaggcaccgatctccacgcgatcgccaataattacccgaccaatctgtgggatcttcacccagttaccacgatcgttggcataaccaaagccgtctgcgcctaccactgttccggactggatcaggcaattctgaccgatctggatctcatggtaaatggttacgttcgcccagagacgcgaacctgcaccgattttgctgtttttacctacgaagcaaccggcaccgataatcacgttatcgcccagttcaacgccggactcaatcaccgcgttagcgccaatcgatacgttgttacccagcttcgccgtcgcgtcaatcaccgcactgggtgcaatgttctgcgcgggctgcggcgtggtatctaaaatttgcgccatgcgcgcgtaagtcaggtagggattcttcactaccagcgcggcacttttcgcgaaaggaagatcgtcctgggtcatgacaaccgcggacgcctggcacaagcctaaatgctcacggtattttggattaaccatgaacgtaatgtgacctgtttgtgcagattgcatggacgcaacgccggtgatgacgatatcgccatcaccgtgtagttctgcatccaactgctgcgctaaatcagccagtcgaattgaaggcattacttatttaacctgtttcagtacgtcggcagtgatgtcttttacatcgctgctgttgtaagcaacggcgtttgcatcaacaaccagatcgatatcctggctgttggcaacggatttcacagcagtctggatacgagtaaccagtttgccgcgttcttcgttggaacgacgtgcgcgatcctgctcaaaagcctgcgctttctgagcaaaagtctggcgctgagccatcacgtctttttccagcttagtgcgatcgctgcccgctttcatggactgcagctttttcattttagcctgcagatcggtttccatacgctgcagttcgctggcacggcctttgaactcgttttccagcgtgttagaaacaccggttttctgcgctacctgctggaacaggctgcccatattgacgattgcaattttgtcagccgcctgagcagaagttgccagtgctaaaccgagacctgcagctaataaccactttttcacaataaactccttaccatcccatttgcaccggagggtgcagttctttgcgtggcccggcgatcttatattgatcgcctaaagtcatcgctacactaccactacattcctttgtggagaacacttaccaggttttaccgatgttaaactggaactgttctgccttgtctccatcgtactttttgaacggctgggcgtaggagaacaccaacggccccaatggggacatccattgtaatgcgatacccgcagacatacggatattgcttggatcactatagtccggatatccagaatattggctggaatcccagtttgtatcccaaacggtacccatatcccagaagaaggaagtacgaaccgagttagcatacttatcgctaataaacggcgtcggggtgatgaactcgaggctggcaaccgccatggcgttaccgcctacagcatcatccgatttacacagatctttcgcgccgtcctgagtcgcacattcgtaatcatagtccggatcataattactggcctgatgcgggaagtaaactgctttcggaccaatggtattggactggaagccacgcacggtgctggaaccaccggcatagaagttctcatagaacggcatctctttgccgcctaaaccatcaccataaccccagcgggtacgacccagaacaacccatttgtgatcgtcatcaatcggcacataagtcgccgtgtctaacgtcactttgtagtattcgttatccgatcccggaatggtcactttaccggtcaggttgacacgtgaaccatctgtcgggaagtaaccacggtcaagcttgttataggtccaaccatagttgaacgtgaagtcgtccgttttgaagctgttatcctgatcagaggtgctcggatgttcacccatagagtacagataacgccacatcgcaacctgaggctgcatgttggacagggagttatgtacataacccagacctgcacgcagcgagttatattcgttgatcgggaagcccaacgtcacgtctgtaccataactcttgttggtatagtcggacaggtcggcgtcatctgcctggaagtcattatagaagagacgaccaccgaggcttacgccatctacggtgaagtacgggttggttaccgacagttcagcataggtctggtaatcgtttttggtcccgttgataccaacagcataacccgtacctaaccagttatcctgttgcacaccagcctggaagctcacgccactttcagtaccgtaaccaatcccgaagttgaagctaccggtgttacgttctttcaccttgtaaactacatcaacctgatccgggctccccggaacacgttgggtatcggtatcgacagtttcaaagaagcccagacggttcagacgctccttaccctgatcgaccagatcgctccccagccatgcaccttccatctgacgcatttcgcgacgcaggacggcatctttcgaggtatcgttaccttcaaaacggatcttacgcacatagaaacggttacccgcatcaacgttcacgcgtaatttaacggttttgtcggcatcgttaatttcaggcatcgactgtacgcgcggataggcataaccatagcgaccaagaagctttttaatgtcatcttccattttggtcactttggtgccgttatacagctcgcccggctcgatcttagtcagttgctcaatttcagcggagtgcccggcaagattgccgctaacttcaacgccagaaagcttgtactgatcgccttcggtgatgttcaccgtgacgtaaataccttttttatctggcgtcagactgacctgggtagaatcgatgttgaaacgggcataaccgcgatccagatagtaactgcgcagggtttcaaggtcgcccgcaagtttctgtttctggtatttacgatcgcctaccacgttccaccacggcacttcgtcacgcagttggaaatgagagatcagttcatcggtggtgaaagcatggttaccaacaatgttaatttgctggatttcagctgacacaccttcctggaacaccagttttaggtcaacacggttgcgcggcagcggggtcacgacagctttaacgctggcgctatatttaccgacgctgtagtagaagtcttccagacctttctcgatatcggcaatggtggtgcgatcgagggattcgcccacacgcacgccagaagcctcgaggttttgcttcagcatgtcatctttcaccgatttgttaccggagaaagtaatgctggcaatggtcggacgttcttttacctgaaccagaagggtatcaccatcacgaaggacgcgaacatcctcaaagttgccggtagcaaacagagcgcgaatggtattactgatatcttcatcattaaccgtgtcgcctgtgcgcaccggcatactgaggagggccgcaccaacggcgacacgctgaaggccttcgaaatgaatatctttcactacgaacccttcagcaccgtatacggtggcgctgctaaacagcagcgacgctatgagcaactttttcatcgccatcgttattatgcgttcttcctaactaactctcataaccgagagaaatcattgaaaagtgcaagccccattaacagcaccagcagaatcgagccaatgcgataacaaaagtcttgaacccgctcggataccggtccgcccttgatcttttcgatcgcaaggaacagcagatgccccccgtcaagtacgggcaacggaaacaggttaattatccctaagttcacgctaataagcgcaagaaacggcaggtaataaactaccccgagttccgctgtcatcccagcccccttggcgatagagatcggcccactgaggttgttcagtttcacatcaccggtgatcaattttcccagcatactgaccgtcagcttcatcaactgccacgttttgtccgtggcttcgacgatagcgttgaacggcccatactggcgtacaactttatactcatctggcaaaggaatgactttcggctcaataccgacaaaaccaatcgctttacccttacccggtttactctccgggattaatgtcaaagacaagggactcccctgcctttcgatttctaacgctaaggatttacccgggttatcccggacaagcatcacaaaggtcacccactgcgttaagggctgaccatcgactttaacgatcctgtcgcctgcttgcaaacctgccttgcttgccgccgagtttggctgcacattttccagtacaggttcaatttgcggcccacgaggacgaatccccaacgaagataccggatcttctttatcaggctcaaacgcccagtgacgtaaatcgagctttacatcccgccgttggtcgctgccaaatggcgctaccgtaatggtggtgctttcatcgccaattttatcgaccaactgcaaacgcacggcatcccaatcaggcgtttcgataccatctacggcttttagttccgtacctggtgcaatttgtgcttccgcagctatcgaattggctgctatttcaccaaccaccggacgtacgccaggcacaccaataataaaaaccagccagtaggcaaagatagcaaaaatgaagtttgcaaccggacctgcggcaataatcgccgctcgttggccgacagatttattattgaaggcatggtggcggagttccggaacgaccggttctgcgcgctcatccagcattttgacataaccgcccaacgggatcagggcgataacatattcggtgccgagcttatcagttcgccgccagagcgccttaccaaaccctattgagaaacgctcaacgcgaacaccacaacgccgggcaacccagaaatgaccaaattcatgcacggtgataagtacacccagtgcaacgatgaacgaagccaaatcccagagaaaactcagcatattaccttccgttaaagcgtcctgaataccagtaacaacaagcaagcaaagaccggtaccgcagccgtcaggctatcaatacgatctaaaataccaccgtgtcctggaattaaatgaccgctgtccttaattcctgcttcacgcttaaacatactttcggtcagatcgccgagcactgaggctaacgctgcgacaatagagcaaatgagtaaggtgacgggagcgacgtcgagattcacccacatgccataaccccatgagattaccgctgcggtcactagtccaccgataaagccttgccaggttttacccggagaaaccttcggtgccagtttatgtttaccaaacaatttgccaaacatatatgcgccagagtcagcgccccataccaggatcatgacatagagcagccatattgcgccactgtaatgattctcgtcgtagtgccaggcccgtaacgccagcatgccccagaagaagggaacaatggttagcacgccaaaaataatgcgcaatgttttagagttacgccagattgctgcggaacctgggtaaaacagcaccagcaatagcgcgacaatccaccaacccagcgaagcccaaagtgagatttcaaccagcggttgatgaatatttcggtgatattccggcaacagaaaaagcatcagcgccaacaataacccacataacaccgccaaccatactcgctgcgaacgagtggtaaaaccgctaagctgtccccattcccacgctgccagcatacagaccaccagcgttacaatggcgaaccccaccggcggcaacagaaacaacgccgcgatgacgacgggtattaacacaaaagcagatatcaggcgatacttcagcaaaagcgacccccatcaggctgtttcatcaccgggctcggtgccgccgaaacgacgctctcgattagcaaaggcatttaacgccccttcaaagtcttgttcatcgaaatcgggccagagaacatctgtaaagtaaagttcggcataggcaatttgccaaagcaaaaagttactaatgcgatgctcccccccagtcctaattactaaatctacaggggccagttcatgcatacagacatgctggtttagcatctcttcatctatctgatctggttgcaggtttccttgctgcaccttttcagccagttgcctgactccctggactatatcccaacgtccaccgtagttcgccgcaatattcagcgtcagaccggtattcccggctgttagcgcttcagatttacgaatacgttcttgcaaacgcgagttaaagcgactggtatcgccaataatacgcagacgcacgttatgtcggtgcagactttttacttcgctatctagcgcccacacaaacagttccattaacgcactgacttcctgcgctggtcggttccagttttcactactaaaggcatacagcgttaacgcctcaataccgttgttggccgcaaaagagacagcccggcggacggattttgccccggctttatgcccaaaggcacgaatcttcccttgcttttttgcccagcgaccattgccgtccataatgatcgcaacatgacgacagccatgcgctggcaatttttcgctaagtggttgagtagcagacaacatcacgcgtttcttattccctgacagggtttacggtactcaggaatactgaagcctatacaaaaaaaagccgtgtaaaaccacggcatacctgaccttataaagccaactacttacgatcagatggcgcagactatatcactgaagccctacgctaacaaatagcgcgactctctgtagccggattatcctcagcttgcgagacgcatcacctcttttctgacgacttcacgcgcgttcgcatcaacagataacacatcatccacacattgtggttcgcgcatatccattttttccagtacggataaattcaacgcggcgatatccgtaaagcggatttgttgcgcaagaaaagcagccacggtgatttcgtttgcggcattcaatgctgtcgtcgctgcctggccttgttcgaacgcctccatcgccagtttcaggcatggataacgatcataatccggtgcggcaaatgtcaacgcacttagtttgcaaaaatcgagcggcttcacgccagagttcacgcgattcggccatgccatggtgtgggcaattggcgtacgcatatccggttcccccagctgcgccagaacactgccgtcctgatagcgcaccattgagtgaatcactgactgcgggtgaatcagcacttccatctggctggcgctggcgttaaacagccaacgcgcttcaatgtattccagacctttgttcatcatggtagccgaatcgacagaaattttacgtcccatcgaccagttcggatgacggcaggcttgatcgggcgtcattgttgccaaatcgcgcaatggcgtctcacggaaagggccaccagacccggtaagtaaaatggacaccacgccattttgctcaaggtcagcgtatcccagattatgctggataggttgcggtaaactctgaaaaatggcgttatgttcgctatcgaccggtaacaattgcgctttgctctgctttacggcgtccataaacagacgtccgcaggtaaccagtgattctttattggccagcaaaatggttttacccgcgcggatcgcagcaagcgtaggtaacagcccagcagcgccaacaatggctgccatcacctgatcaacatcctcaagcgctgccatatcgcaagcggcttgttgcccacttaagacttcggtgcggctaccctgttgctgtagcatcgttttaagaagtttcgcactcgcttcatcgtccattacagcatagcggggagagaattccaggcactgttctaccatgcgagcgacatttttgcctgccaccagcgcaactacgcggaagtgttcgggattatggcgcaccacgtccagcgtgctgcaaccaatcgagccggtcgagcccagaatggtgagttgcttcatgaaacatccagagttgagacagaataaaaagcaaaacgccgccagccgatccgcaaggatctactgagcggcgtttttgtcgttcaagaaatcagaactgcatcagttctgcttctttgtctgccagcgccgcttcaattttcttgattgcagcatcagtcagtttctgtacatcgtcctgagaacggcgatcatcgtcttcgctgatctctttatctttcaacagtgctttcactttgtcgttcgcgtcacgacgcacattacgtactgcaacacgcgcttgttctgcttcaccacgaacgattttggtcagatctttacgacgttcttccgtcagcggcggcagcggaacacggatgtcgctacccgcagagttcgggttcaggccaagatcggacgccataatcgctttttcaacggccggagacattgaacgatcaaacacgttgattttcagagtacgggaatcttctaccgttacgcttgccagctgacgcagcggcgtcggcgtgccgtaatattccacgacaatgccatccagcaggctgggagaagcacgacccgtgcgtattttgctgatttgggttttgaacgcttctacgcatttatccatgcgtacttcagcatcttttctgatatcgctaatcacgttacgaatccttgaaaacttgtctcagtcagaccagacagtcacacacagtggaagtgtgctaagtatagccctgattaaacatattacgggtaagatcccccgcgatacttacgcggaatcttacccttatttatccatcacgggaattattccgtgattaaagtcccttctttttcacccattaccacacggcgcagcgcacccggtttgttcatgttgaaaacacgaatcggtaatttatggtcacgagcaagcgtgaaggccgccaggtccatgactttcagctctttttccagcacttcgctgtaagtcagttgctcgtacatggttgcggttggatctttcgccggatcagcagtaaacacgccgtcaactttggttgctttcagcaccacatcggcttcaatttcgataccacgcaggcaagctgctgagtcggtggtaaagaacgggttacctgtaccggcggagaggatcaccacacggttgttgcgcaacaggctgatagcttctgcccagctgtagctgtcgcacacgccattcaatggaatagcggacatcagacgagcgttcacataggcgcggtgcagtgcatcacgcattgccaggccgttcattacggtcgccagcatccccatgtggtcgcccacaacgcggttcatacccgctttcgccagaccagcgccacggaacaggttacccccaccaatcaccacaccaacctgaatacccagttcaaccagttctttgatttcctgagccatgcgatccagtatgcttgcatcaataccgaagccttcagtgccctgcagagcttcgccactcaacttaagcagaatgcgtttatagacgggttttgcattggtagccatgtttctttcctgagactgtcaacgattgaaatgaattaatactagcgacattgtacgtcgcttttcagcgcagccctacaagggttagctgaatttacaagatgggcacaaaaagaagccgccctcaggcggctccttttcgataattaagactgcttggacatcgcagcaacttctgctgcaaagtcagtctcaactttctcgatgccttcacccacttcgaagcggatgaagccagtcacttcagcgttatgctctttcagcagctgaccaacagttttgcttggttccataacgaacggctgaccggtcagagaaacttcgccggtgaatttcttcatgcggccttcaaccattttctctgcgatttctttcggcttaccagactgcatcgcgatatccagctgtacctggtattctttttctaccacttcagcggatacgtcttctggtttgatgaattctggcttgcttgcagcaacgtgcatagcgatgtgtttaaccagctcttcgtcagcgcctttagcagcaaccagaacaccgatacgcgcaccgtgctgataagaacccagaacgtcgccttccagcgcagcaacgcggcgaatgttgatgttttcaccaattttcgctaccagcgcaacacgttcttcttcgaactgtgctttcagtacttcaacgtcagtgattttgccagcaacagctgcgtccagaactttgtctgcgaacgcctggaaaccagcgtcttttgcaacgaagtcagtctggcagttaacttccagaatgatgccgtagttgccgtcgattttggttttgatcacgccgtcagcagcaacgttgcctgcttttttcgctgctttaatagcaccggacttacgcatgttttcgattgccagctcgatgtcgccgttagcttcagtcagtgcttttttgcaatccatcatgcctgcgccagtacgctcacgcagctcttttaccagggatgcggtaatttcagccattctaaaatcctcggagatgtgatctgcccggcattaaaccgcacagatataaaagtgaaaaagggggccatatgcaggccccctaaccaaacgtgtactacctggtctataagggctcgtacgagcgtgccttattactcagcttctacgaagctttcttccgcctgggaagccagatcctgagaacggccttcacgtacggttgcagcaacagcgcccaggtacagggtcacagcacggattgcgtcgtcgttacccgggataacgaagtcaacaccgtccggatcagagttggtatcaacgatagcaaataccggaatacccaggttgtttgcctctttgatagcaatgtgttcgtggtcagcatcgattacaaacagagcgtccggcagaccgcccatgtctttgataccgcccaggctgttttccagtttctccagctcacgagtgcgcatcagcgcttctttcttggtcagcttgtcgaaagtaccgtcctgagactgagtttccaggtctttcagacgtttgatggactgacgaacggttttccagttagtcagcataccgcccagccagcgatggttcacgaagaactggtcgcagctcagagcagcgtctttcaccgcttcgcttgcagcacgtttagtaccaacgaaaaggattttacctttgcgagaagcaatcttgttcagttcagccagagcttcgttgaacatcggtacagttttctcaaggttgatgatgtgaactttgttacgcgcaccgaagatgaacggcttcattttcgggttccagtaacgggtctggtgaccgaagtgaacaccagccttgagcatgtcgcgcatggaaacagttgccatgattaaaacctctatataaaagttggggttatgcctccacgtatcccatattaccgaccccaaagggcaccccggaatatgtgccgatacgtgtgtgttgttacacaaagtgagattgtcgcttccgtccagtctgtgtatacgaaatggatcggaagtccggcgcgctttataccacaaatacgtcgtggacaccaataattgttggcgctgtgtacagcatcagacgttgaattttctattatagaaaaccttcagtggcacgtttggcgaaattcagaatgattctcaatttgcccgggtgtgataccattgacggcacttacatatatattgtcggtatcaccgacgctgatggacagaattaatggctatctcaatcaagaccccagaagatatcgaaaaaatgcgcgtcgctggccgactggctgccgaagtgctggagatgatcgaaccgtatgttaaaccgggcgtcagcaccggcgagctggatcgcatctgtaatgattacattgttaatgaacaacacgcggtttctgcctgcctcggctatcacggctatccgaaatccgtttgcatctctattaatgaagtggtgtgccacggtatcccggacgacgccaagctgctgaaagatggcgatatcgttaacattgatgtcaccgtaatcaaagatggtttccacggcgatacctcgaaaatgtttatcgtcggtaagccgaccatcatgggcgaacgtctgtgccgcatcacgcaagaaagcctgtacctggcgctacgcatggtaaaacctggcattaatctgcgcgaaatcggtgcggcaattcagaaatttgtcgaagcagaaggcttctccgtcgttcgtgaatattgtggacacggtattggtcgcggcttccacgaagaaccgcaggtgctgcactatgactcccgtgaaaccaacgtcgtgctgaaaccggggatgacgttcaccatcgagccaatggtcaacgcgggtaaaaaagagatccgcaccatgaaagatggctggacggtaaaaaccaaagatcgcagcttgtctgcacaatatgagcatactattgtggtgactgataacggctgcgaaattctgacgctacgcaaggatgacaccatcccggcgataatctcgcacgacgaataaaatgaagccggcgaatgccggcttttttaatgcaataatttaatcttatgggtggcgcacaatgaatacccttccagaacagtacgcaaacaccgctctccccaccctgcacggtcaaccgcaaaatccatgcgcctggccccgtgatgaattaaccgtcggtgggataaaagcccatatcgatactttccagcgttggctgggtgatgcctttgacaatggtatctccgcagaacagttgattgaggcgcgtaccgagtttatcgaccagcttcttcaacgattatggattgaagcgggattcagccagattgccgacctggcattggtcgccgtcggtggctacggtcgtggcgagctgcatccactttctgacatcgatttactgattttaagccgtaaaaagctcccggacgatcaggcgcaaaaagtgggcgagctgttaacgctgctctgggatgtaaagctggaagtaggtcatagcgtgcgcacgcttgaagagtgcatgctggaagggttatcggatttaaccgtcgccaccaatttaatcgaatcccgcttattaattggcgatgttgcgctgttcctcgaactgcaaaaacatatttttagcgaaggattctggccttccgacaagttctacgcggcgaaagttgaagaacagaaccagcgccatcagcgttaccacggcaccagctacaaccttgaaccagacatcaaaagtagccccggcggcttgcgcgatatccacactctgcaatgggtggcccgccgtcattttggagcaacatcgctggatgaaatggtagggtttggcttcttaacctctgcggagagagcggaattaaacgaatgcctgcatatattgtggcgcattcgctttgccctgcatctggtcgtcagtcgttacgataatcgcctgttattcgatcgccagcttagcgtcgcccagcgtttgaattacagtggtgaaggtaacgaaccggtcgagcggatgatgaaggattacttccgcgttacacgccgcgtcagtgaactcaaccagatgctgctgcaactgttcgatgaagccatcctcgcccttcccgccgacgaaaaaccacgtccaatcgacgatgagtttcagctacgcggaacgctgatcgacctgcgtgatgaaacactatttatgcgccagccggaagccatcttgcgtatgttctacaccatggtgcgcaacagtgcgatcaccggcatttactccaccacgctacgccagttacgccacgcccgtcgccatctgcaacaacctctgtgtaatattccggaagcgcgaaaactgtttttgagcattctgcgtcaccccggagcggtgcggcgcgggctattgccaatgcatcgccatagcgtgctcggcgcgtatatgccgcaatggtcgcatatcgtcgggcagatgcagtttgacctgttccatgcctacacggtggatgaacatactatccgcgtgatgctgaaactggagagttttgccagtgaagaaacgcgccagcgccatccgttgtgtgtggacgtctggccgcgcctgccgtcaactgagctgattttcatcgccgcgctgtttcacgatatcgccaaaggacgcggcggcgaccactccattctcggtgctcaggatgtagtgcattttgccgaactccacgggctgaactcacgcgaaacacagctggtcgcatggctggttcgccagcacttgctgatgtcggtgaccgctcagcgccgcgatattcaggacccggaagtcatcaagcagtttgccgaagaagttcaaacggaaaatcgtctgcgctatctggtatgcctgacagtggctgacatttgcgccaccaacgaaacactgtggaatagctggaagcaaagtctgttgcgcgaactctattttgccaccgaaaagcagctacgacgcggaatgcaaaacacgccggatatgcgcgaacgggttcgccatcaccaactccaggcgctggcactactgcgcatggataacatcgacgaagaggcgctgcaccaaatttggtcacgctgtcgcgctaactattttgtccgccatagcccaaatcaactggcctggcacgcacgccatttattacagcatgatttaagcaaaccgctggtactgcttagcccgcaggctacgcgtggaggcaccgagatttttatctggagcccggaccgcccctatctgtttgccgccgtctgtgccgaattagaccgccgcaatttaagtgttcacgacgcacaaattttcaccactcgcgacggtatggcgatggatacctttatagtgctggaacccgatggtagcccgctatccgcagatcgtcatgagattattcggtttggtctggagcaagtactgacacaaagtagctggcagccaccgcagccccgtcgccaacccgccaaattgcgccattttactgttgaaaccgaagtgacgtttttgccgacccataccgaccgcaaatcgttcctcgaactgatcgccctcgaccaacctggactgctggcgcgagtcgggaaaatttttgccgatctgggaatttcgcttcatggcgcccgaattacaaccattggcgagcgagtagaagatttattcataattgccaccgctgaccggcgtgcgcttaataacgagttgcagcaggaagtgcatcagcggttgacagaggccctcaatccaaacgataaagggtgatgtgtttactgatatgaaaagagtttaacaatgcagcagttacagaacattattgaaaccgcttttgaacgccgtgccgagatcacgccagccaatgcagacaccgttacccgcgaagcggtaaatcaggtgatcgccctgctggattccggcgcactgcgtgtagcggaaaaaattgacggtcagtgggtgacgcatcagtggttgaaaaaagcggtgctgctctctttccgtattaatgataatcaggtgatcgaaggggcagaaagccgctacttcgacaaagtgccgatgaaattcgctaactacgatgaagcacgtttccagaaagaaggcttccgcgtcgtgccaccagcggcagtgcgtcagggcgcgttcattgcccgtaacacagtgctgatgccgtcttacgtcaacatcggcgcatatgttgatgaaggcaccatggttgatacctgggcgaccgtcggttcctgtgcgcagattggtaaaaacgtccacctttccggtggcgtgggtatcggcggcgtgctggagccgctgcaggctaacccgaccattattgaagataactgcttcatcggcgcacgctctgaagtggttgaaggggtgattgtcgaagaaggttccgtcatctctatgggcgtatacattggtcagagcacccgtatttacgaccgtgaaaccggcgaaatccactacggtcgcgttccggcgggatctgtggttgtttcaggcaatctgccgtcgaaagatggcaaatacagtctttactgtgcggttatcgttaagaaagttgacgcgaaaactcgcggcaaagttggtattaacgaactgctgcgtaccatcgactaaaagtatgtacacgggcagcacgacgctgcccgattgctttctggctcagaataattcgtcctactcattttcccccttttttaaatactttttcatcttgtttcggactgtcatgtaattcgcaaaatgaagataaatgtgctaatccatcccatggaatatcaccacaataaagcaggtaattttttgatttttacgccatgatagaagtctggaagaaaaaggctttctgcgatcacagtcgagccgggcgggccaggccaaatgctaaaataagcacaatttactgactcattttgaggtaacgctatgtacgacaatctgaaaagtctgggtattaccaatcctgaagaaattgatcgttacagcctccggcaggaagccaacaacgatattctgaaaatctatttccagaaagacaaaggcgagtttttcgccaagagcgtgaagtttaaatacccgcgtcagcgtaaaacggtcgtcgctgatggtgtgggtcagggttataaagaagtccaggaaattagcccgaatctacggtatatcattgatgagcttgatcaaatctgccagcgtgaccgcagcgaagttgatcttaagcgtaagatcctcgacgacttacgtcacctggagtcagtagtaaccaataagatcagcgagattgaagccgatctggaaaaactgacgcgtaaataatgccattctgtgggccgggtaaagtctcacccggctgtaattttgtaatcgacctaccgctcttcatccagttgtaacgccacatacagcagcaacctgtcatcaaaattgcccaaatcaagcccggtcagttccgatatacgattaagccgatattccagagtattacgatgaataaacaacgcctttgacgttgccagcggttgcacattgtggcgaaaccacgccgccagcgttcgccgcagcaagccgttattgtccatcgctttcagccgcgccagcggtcgcgccagttcgttggcctgccagtcgccacgcaaactgtcgagtaacacaggtaacatcagatcctgataaaaatagcagcgactttctggcatccgctgtttccccactaccatcgtcgttttcgccgtacgataggatcgggcaatactgccaggaccggtaaaatagttgcccagcgaaacgcgaaaacgcaactggccatactctttcatgcgggtaatcagttgttcaactcgcttacgatgatcttctgcgtcccagcgcccaaaagagttcaacgccggtttcaacaccaccatttcggttagcgagacaatcgccaccagattattacgctcgggcgtagtcagcgcattttgcagttgctgtaactccgccattgcgctgtccacgccaagctgaccgctgtcgacctcaacaatagccaccactcgcggttgattgagatcgatccccagccgttgcgcccattcagtaagtgcgggagtattctcctcagcctgaatgaggttcatcaccagttcttcccgcaaacggctatcctgcgccaacaggtgcatcaaccgcgactgttccagcatcatttcagccgtcatgcagaccagttcgccatatttacgcagattctctggttcacctgtcaggccaattacgccgacaatttcaccttccagccgtaacggtagattaatcccctgccgcacaccgtgcagatgacgtgccaccgcgtcatcgatatcgacgactcgtccttgtgaaagtaccagcaatgctccttcgtgcaattcaccaatacgctcacgatcgccgctgccgataattcgcccgcgggcatccattacgttgatattggtatcgatgatgcgcatggtacgtgccacaatatcctgcgccattttggtatcaagatgccagccagccataagtcctccattatgcacggcttagcataaggaagtacgtaacgtacggcattgtgcaaatgcccaaaggatgatgaagatgtatggagttgtggtgaagttcacagattgtaaggagaaccccttcccgttttcaggaaggggttgagggagattactgcattaacaggtagatggtgctgtcgccgcgctgaatgttcagtgccagcacagacggtttgctgtcgagaactttacgcagttcagcgatgtttttcactgcctgctggttcgcgccaataatcacatcacctttcttcaggccgatctgcgcagccggagtgcccgttttcacgttgttcaccaccacgccctgatctttgcctttgttgctcatctcagcgccttcaatgccgttgaagatggtgctggaatcaacctgattctggctgctctgctgaagttccaggttcacgttaacctgcttcccatcgcgcagtaagcccagggtcagtttgctacctaccggcatagtgcccacctgagcacgcagtgcggcaaagctgctgattggcttaccgttcagtgaggtgatcacatcccccgctttaatgcccgctttcgcggcggaagaattcggcagaacctggcttacgaaagcaccgcgctgggcgtcaactttcatcgctttcgccagatcggagttcagctcagtgcccataatacccaactcaccacgtttcacctggccgtattccaccatctgcgaggtcaggtttttcaccatgttgctcgggatagcaaaaccgataccgatgtttccgccgtccggtgcgagaatcgcggtgttgataccaatcagttcgccgttcaggttaaccaacgcaccacctgagttaccccggttgatcgctgcatcagtctggatgaagttttcgtagttttcagcgttcaggccgctacgtcccagcgcagagacaatcccggaagttactgtctcgcccaggccgaacgggttaccaattgctacggtgtaatcacccacgcgcagcgcatcagaatccgccatcttaattgcggtcaggtttttcgggttctggatctggatcagcgcgatatcagagcgcggatctttgccaaccatcttcgcgtcgaacttacgaccatcgctcagttggactttaatcaccgtcgcgttatcaacaacgtggttgttggtgacgacatagcctttatcggcatcaatgataacgccggaacccagcgccatgaatttctgttgctggccgccgccattaccgccctggcccccctggcagaacggagagctctggaacggagaaccctcctggcagaacggagaatcatcaccgaagaactgctggaaattacgcggcatacgcggcgtattaacggttgtgctaccttctacgttaatgctgaccactgaaggcatcaccttttcgagcatcggtgcaaggcttggcatctgctgggctgtcgttgctgaagaagtctcagccgccgttgcagagagcggagataacgccaaacctaaactcagagccagtgcactcagtgctaatgtggtttttttcatgtatttcagtctcgattaacagataacgcaaaattgctgtgttcttcagattcgttttatagcgcgaagttccgaactaaagtttctgcaaaaggtaaaaatttattgttcgtctttacaaaagcctggttattgttctacggccatcagacgtcggtattcatcccacgcatagaggtcggtcataccgctgatataatcctgcagcaggcggcaacggtaataatattcccatagcggaaactcaggagaatctgacggtaatttactgacagcctcgacataggccagccgatggcgcgtcgagagtttgtggaataagcgcgtttcaatagggaaacgtttcacccgttctttttctaccagttcagtaaagtctgataacggcaggtttaataaaggacgataaatctctaataatccgctaatgacccgatagccctgcaattcaagctgctcgacatctggatggctaaacacatgttttacagcgacatttttatatagcttaagaagatcgctgcattcgctggcatcttccaataatgcatgattaaacgttccggcgaaaatcgcaggcagattatcaataaatcgttgtgccgcatagggtaccagtttatttagggtgtttacccgtaaatacataaaaaactgatcttccgtactgcggcttaaactatttgagcgtgatttttcccaggcattttcaaccaccagcgaaaagagcgaacctttctcatgctggccccacgcctcgtgcaaatgatgataaagctgctcaacggtaaatatccttttctctaccgcatcttcaaggtctgccacacaataggagatgtcgtcggcagcttccataatccacgttaacggaaaacgactgtaaagcgccaaattaagttctttacgcaaccgggcaatataggcttcttcggaaagataatagcccggctttttcattaaatagtgatgtgtctcaggcgtttcgccacgccaccacgccggacgggtatattttaaaataccgccaacctgtgcccaggtgagattcatccgcatcaatgtatgcaccaaacgaataccctgtgcgttaccttcaaaatgacataagtcctgacgaatcttgcgccgcagcgcgttaagcggttcttccccgtcccgtaaacgtagtgccgccacgctgcagcgatcgtcagtcagaggctggctttcggcatcttccgggtacaaacgctggcgaaaccagtcatttatcgccgcttcgccaaaatgaccaaacggcggattgccgatatcgtgcatcaggcatgacatctcaacaatgctttcaaagggcccggtcagttcatcgagaccatacgcctccagtaatttaagctctttcaaacggcttaaaatttctttagcgatgtagcgccccacctgctggacttccatcgagtgggtaagacgcgtgcgcacggcggcattgcgctccagtggaaaaacctgggtcttttgttgcagacgacgaattgccggagagttgatgatacgcccgcgatcgctctcgaagatccgcagaatctcatgttcggttttaacgccctgcggtgaacggtaacgacgatgccagtttattttttttcggaaatcaatctgtgccatgtcctctcccgcgtgagaaatacgcttccccgtaagcgcatggtaaactatgccttcaaatcgggcttatcgcgagtaaatctatgaaaatcggcatcattggtgcaatggaagaagaagttacgctgctgcgtgacaaaatcgaaaaccgtcaaactatcagtctgggcggttgcgaaatctataccggccaactgaatggaaccgaggttgcgcttctgaaatcgggcatcggtaaagtcgctgcggcgctgggtgccactttgctgttggaacactgcaagccagatgtgattattaacaccggttctgccggtggcctggcaccaacgctgaaagtgggcgatatcgttgtctcggacgaagcgcgttatcacgacgcggatgtcacggcatttggttatgaatacggtcagttaccaggctgcccggcaggcttcaaagctgacgataaactgatcgctgccgctgaggcctgcattgccgaactgaatcttaacgctgtacgtggcctgattgttagcggcgacgctttcatcaacggttctgttggtctggcgaaaatccgccacaacttcccacaggccattgctgtagagatggaagcgacggcaatcgcccatgtctgccacaatttcaacgtcccgtttgtcgtagtacgcgccatctccgacgtggccgatcaacagtctcatcttagcttcgatgagttcctggctgttgccgctaaacagtccagcctgatggttgagtcactggtgcagaaactggcacatggctaagtcactgttcagggcgctggtcgccctgtcttttctcgcgccgctgtggctcaatgccgcgccgcgcgtcatcacgctttctcccgccaacactgaacttgcctttgccgccgggatcacgccggttggggtcagcagctattccgactatcctccacaagcgcaaaagattgggcaggtttccacctggcaggggatgaatctggaacgcattgtcgcgctgaaacccgatctggtgattgcctggcgtggaggtaatgccgagcggcaggttgaccagctggcttcgctgggaataaaagtgatgtgggtcgatgcgacaagcattgaacaaattgccaatgcgttacgtcaactggccccctggagtccgcaaccggataaggccgaacaagccgcgcaatccctgctggatcagtacgcgcaattgaaagcgcaatatgctgataaacctaaaaaacgtgtttttctgcaattcggcattaatccgccatttaccagtggaaaagagtcgattcagaaccaggtactcgaagtttgtggcggagaaaacatctttaaagacagccgggttccctggccgcaagttagccgcgaacaggtgttagcacgctcgccacaggcgattgtcattacaggcggaccggaccaaattcctaaaatcaaacaatactggggtgaacagctcaaaattcccgttattcctctcacgagtgactggtttgaacgtgcaagcccacgtattatcctcgctgcacaacagctctgtaatgcgctttcacaggtagattagtgcctgaccttttcaggtgctcagtggggattgaacaatgctcgtctattggctggatatagtcggcacagcggtatttgctatctctggcgttttgttagccggaaaattgcgtatggacccttttggcgttctggtattgggcgtggttaccgcagtaggcggcggaacaattcgcgacatggcgctggatcacggcccggtattttgggtgaaagatcccaccgatctggtcgttgcaatggtcaccagcatgctgaccatcgtgctggtgcgccagccaagacgcttaccaaaatggatgttgccggtgctggacgccgttggtctggcggtgtttgtcggcattggcgtgaataaagcctttaatgcggaagccggtccgttaatcgcggtttgtatgggcgtcattactggcgttggcggcgggatcattcgtgatgtactggcccgcgaaatccccatgattttacgtacagaaatctacgccactgcctgtattatcggcggtattgtccacgctacggcttattacacattttccgtaccactggaaacagccagtatgatgggcatggtcgtgacgctattgattcggctggcggctattcgttggcatcttaagctaccgacgtttgcgctggatgagaatggtcgttgaagagaggagatgtgccggatagtttatccggcacatgaacagcagattagatactaaaggaagaaccgcaaccgcaggtacttttcgcgttcgggttggtcacgatgaaacgagaaccttccagaccttcggtatagtcaacggaaccgccgaccagatattgcaggctcatcggatcaaccaccaggccaacgccctgtttttcgatggtcatatcgccttcattcacctgatcatcaaaggtgaaaccatactggaagccgctgcaaccgccaccggtgatatacacgcgtaatttcagattcgggttatcttcgtcagcgatcaggcttttaactttgttggctgctgcgtcggtaaactccagcggcagtgctacgtcatcactcatattttgctccaaacgacatcggcaattgggcaaattctaacccaataataatcgccattatctaataccctggtatttcgttcaagtattctcgctggctgatgcggccttgcttcgcgccagttgctcagcttcctgttttgccagcgtgcgcgcaagaatcgccgagtatagcggtttcccaccggtaaattgtgctaatagtgttgcgccaagaccggtaataatcattggcaaaatgagctggtagttatcggtcatttccagaaccagaatgatccccgttaacggcgcgcgaatagatgccgccagtaacgcccccattccggcaatagcaaacgtccccgcctcaaggtgatattgcggaaacaactcaacggcaaccattccgaaagcggttcccagcacagtacccagcgccagcatcggggcaaaaataccgcccggcgcgccggaagagaagcagagtaaggtggtaatgacccgcgcgacgaagataaacaccagcattcccatgctgaaattccccgcggtagcgataggaatcaggttaaaaccgccgcccgaagttgctggtgccacaaaccccagcaatccacacagaccgccaatcgcaccacccatcagtacccatttggtaatattgccaccgtgcacacggtgcagcaaatcctgcatccccagcacccatttattaaaaatagggccgaaaatgccaaaaataataccgaggatcagataaagccacagcgtattaagcggcgcatcagaaagtttaccgacgtcaatcaacgcaacttcatgattaaaaatccggtacataatggtcgacataatgacgccaataaataccgctttaatcgaaattaacgtatagcgaaactgcggacgcatctcttcgataataaacaaaatacccgccagcggcgcgttaaaggccgcagccagccccgcagcagcaccggttgccaacagcgtatgacgagcttcgtcacctttcaggcggaaaacatcgagtaccatccgcccgatattgccgcctatctgcacggttggcccttcgcgccccaacaccatgcctccgccgagtgttcccagcccgccaaagaatttcaccggcaacacacgccaccagcgaacgggacgttgatcttccagcgccccttcaatttccgggatccccgaaccacctgcttccggcgcgtatttgcgcaccaaaaagtagccgaacatcgccagcaccgccgaacagagaaaagcgacggttaacagaagcggataattatcagcagtatgtaccagtgcccccatacgttggttctgcaaccaggcgacacctttgtcaaaagcaaccgcagccagcccgacaagcgtgccgacgactgccgccataaacaaaatggctaacggggttttatcgcgctcaagaagttggcgaatcagttgtctgcgtcgcaggcgcgcggcctgcggtgtttctaaagagggagtatcagttttcatccaatgatcacttattggtcatacaaataagatgacggcattttactcgcacgttccatgaaaatcctttgcaaagcgtaatgtttcaaatgcacaaaacttttatactctaagaaatcaggattgcaccagtacaagcagcctgatgtttgacgagtatttaacttgttatgaataacatagaatagcagccattcactttttctacgaatcaggaaccctccatgagtaagtctgaaaatctttacagcgcagcgcgcgagctgatccctggcggtgtgaactcccctgttcgcgcctttactggcgtgggcggcactccactgtttatcgaaaaagcggacggcgcttatctgtacgatgttgatggcaaagcctatatcgattatgtcggttcctgggggccgatggtgctgggccataaccatccggcgatccgcaatgccgtgattgaagccgccgagcgtggtttaagctttggtgcaccaaccgaaatggaagtgaaaatggcgcaactggtgaccgaactggtcccgaccatggatatggtgcgcatggtgaactccggcactgaagcgacgatgagcgccatccgcctggcccgtggttttaccggtcgcgacaaaattattaaatttgaaggttgttaccacggtcacgctgactgcctgctggtgaaagccggttctggcgcactcacgttaggccagccaaattcgccgggcgttccggcagatttcgccaaacataccttaacctgtacttataacgatctggcctctgtacgcgccgcgtttgagcaatacccgcaagagattgcctgtattatcgtcgagccggtggcaggcaatatgaactgcgttccaccgctgccagagttcctgccaggtctgcgtgcgctgtgtgacgaatttggcgcgttgctgatcatcgatgaagtgatgaccggtttccgcgtagcgctagctggcgcacaggattattacggtgtggaaccggatctcacctgcctcggcaaaatcatcggcggtggaatgccggtaggcgcattcggtggtcgtcgtgatgtaatggatgcgctggccccgaccggtccggtctatcaggcgggtacgctttccggtaacccgattgcgatggcagccggtttcgcctgtctgaatgaagtcgcgcagccgggcgttcacgagacgctggatgagctgacaacacgtctggcagaaggtctgcgggaagcggcagaagaagccggaattccgctggtggtaaaccacgttggcggcatgttcggtattttctttaccgacgccgagtccgtgacgtgctatcaggatgtgatggcctgtgacgtggaacgctttaagcgtttcttccatatgatgctggacgaaggtgtttacctggcaccgtcagcgtttgaagcgggctttatgtccgtggcgcatagcatggaagatatcaataacaccatcgatgctgcacgtcgggtgtttgcgaagttgtaatgattttgcctcgcccaccgggcgaggcattctattaacggctctgctttctcaacaaatagataaaatatggcgcgccgataaaggtcgacagcagccccgccgggatctggaatggaaacaataccatccgcccacaccagtcagcgaacaccagcagtaaaccacccaccagcgccgaaattacgatgtgtggcatcgtccgtcgaaagcccatcatccgcgcaatatgcggtgccattaaaccaacaaaactcaacggtccaatggtcattgtcgcggtcgccgtcaggcaagccgctaacagcagcagcgcaattcgcgtcggcgtcagcgccatccccacggctcgtgcggtatcaccacccagcggtaaaatggtcagccagcggcggcacagcggggtaatcgccagcaaaatcaccatcacaattccggtacgccagacctgcgcatcggtcgcgttgtaggtcgaaccggaaatccaggtcagaacttgcgccattcgcgggtcaccacttgcctgcaacatcatcaaaagcatggtgaacgcggtacttaacgccattcccgccagtaacatgcggtgtggggaaaatccaccacgtccggcggcgatcataatgatcaacagcgtcaccgccgccccgagactgcctgcgggtaacagccagccaaaggcattacccggcaccagaaacagcattaacaccacgccaaacgccgcgccggagctaatccccagcacttccgggcttgccatcgggtttccggtcagccgctgaataatacagcccgccaccgccagcatgacgcccgcaaacagcgcagccataattcgcggccagcgccagggcatcaaatcctcgagcaacgccccgctcgcccacgtccagccgtgcgcatcacgacccaacgacagcgccaccaccacagccatcaacagcagcacgccgcccgcgagggcaaacgccagcacgtgttggcgttcagtcgcgacacgatcgttcaccttcatatccggcgcgctaatgctgcgtaaacgcggcagcaaccacagtagcagcggcgcaccgatcaacgcagtgaccgaaccggtggacacttccatccacacgcgagtcagccagaggatgatttgatcagaaagccacagaattaacgcaccaatcagcgatgccagcatcaaccgtggcaacaaacgccgcgcccccagcattttcgccagcagtggcgcgaacaacccgataaagccgataatccccaccgcgttcaccagcagcgcactgatgacaatcgccagcgacaacgccgccagacgagcgagcgacaaggccagcccgagattgcgcgccacgccatcatcaagccccatcagagttaacgggcgaagtagcaataacgtcagcatcacgccgcccagcagctgcggccataaacgctcaacgccgccccagtcggtttgcgtcagtgttccggtgctccacaggaacatgctttgcagttggtcatgatggaagataaccagtaactgattgattgccccacaataaaggctcaccaccagccccgcgaggatcagcgttaccggcgaaagccgtttcccccacgcgacgccaaagacgattaagccaacaacgcaagcgcccgccagcgcagcaaactggctcgccatcgcgccggggatcgcccagagcgtcgtgacggtaatccccagttgcgcgcctgtagcaacgcccaacgtcgtcggttccgccagcgggttacgcagcacttgctgaaacagcacgcccaccagccccaggcccgcgcccaccagcagcgaaatcgccagacgcggcagcaagctgtagtgaaaaatcatctgctcgatgacgtcaatatccggcgaccaggcggcctgcgcccactggctgcgcggcagcgcctgcgaggagttcatccaggtgagcgccgatgcggcaaccaccagcagcgccagcaataacgccgggaaaagcgcaattcgtttactcacgctttacctccgatggcgttatccagaatacgcacaaagtgcattgccgaaagcgtcgcgccatagaaccagaccgccggaacgcgctgaaagcgtccggcgcggacaaacggcatggcctgccacagcggggttgccattagcgcattcatgtctttgctgttgtcgtgatcaaaacagagcacatcaacgtctttatacgccgccagacgatcgatactgacggcggtactgccccagaagttggtttccccttgccaggcatttgggatgccgtactcatcgagaatttcctggaacaagctgtttggaccgaagaccaacatatggcgcggatcgataagcgtcgtcagcaataacgggcgtgcaccacgcttcacaaagcggggtttcatgctgcggataaagtcttcatagtgcgttaaatgcgtttccgctgcgctttgcaggttaagtaaatctgccatttccgtcagtgatttacgcgccatcgccagtggctgtttgccgtcgctgaagttaaatccgcgccccggcgcaatacgtgccagcatttctggtgaagggccatatcctgcagaccagaccataaacgacggtttcatttcggtcagcagttcaaggttgggttctgtacgcaaaccaacgtcaatcactgagtccggcaatggcggttcgctgacccacaggcgatagttgatggtgtccgccacgccgtaaggcacgatgccgagcgccagcagtaactccaccggcaaccactccagtgccacaatacgattgggatcaataactgccgcgtgggcggtattcatctgccataagaacggagaaagcgccatcgccgttaacagtcggcggcgcgaaataagaggtaagccgctcatcaataaacaaaactcacaggtgcagcacccgccggatgcggcagaatacccatcgggatgccataaatcatttcgagggtttcgccgcgcataatttccgcaggcgttccctgagcaatcatttcaccgccgcgcagggcgaccagataatcacagtagcgcgccgccatattgatatcgtgcagcacggcaatgaccgtcaggccacgctcctgacttaaacgatgcaccagcgccagtacatcaacctggtgggcgatatccagcgccgaagtcggttcgtcgagcaacagacagcggctatcctgcgccaccagcatggcgatccacgcccgctgacgttcgccgccagaaaggctatcgaccagccgatgcgccagcggttttaagccaaccagcgagatagcttcctcgaccttttcgcgatctgccgcaccaaagcgccctagtgcgccatgccacgggtaacgaccaatcgccaccagttcacgcacggtcatcccttctgccggaggaagctgctgcggtaaataagccactttgcgggcaaacgctttgctgctccagctttccagcggttgggcatcaagaagaatctccccttccgacggtggctggtgacgaccaagcattttgagcagagtggatttaccagaaccgttgtgaccaatcagaccagtcactttcccggcaggaaaggttaacgacaacggatgcaaaagcgtgcgcccgggcacacgaaaggagatattacgcagtgcaaaagtggtatcggaatgattcgtgtattcctgcataacagccaacttgtgaaacgggcacggaaatccgtgccccaaaagagaaattagaaacggaaggttgcggttgcaacgacctgacgttctgcgccccagaagcaaccataagtgttaaagcagctggcgacgtattcacgatcaaacaggttgttgacatgcagcgccacgttggagcccgccatgccgactcgcgccagatcataacgcactaacgcatccacgaccgtataacttcccactttaaaggagttagccggatcaccatagctggagccagtataacgaccaccggtgcccagcgtcagacctgaaagcggaccgtcaaagaaggtatagtcagcccacagcgaagccatgtgttttggcacctgtgcaggcgtattgcctttgtaggtagtatcggtagtgtattccgcatcggtgtaagtataagaaccgactacgttaacactcgccgacagcgccgctttcgcttcgatttctacgccacgagcgcggatctcgccaccttcaaccgagaagaaggaaccctcagggtccgccatcaggttgttggttttagtaagattatacacggcaccagtaactacaatcggacgatcttccggtacatatttcacgccgacttcatactgcttacctttagacggtgcgaaaatattaccatccttcccaacttgcgaagaaggttcaaacgattcgctatagctgaagtatggtgttacaccattatcaaacaggtagttaacaccaccacgccaggtaaactgtttgtcatcacgtttatcggtcgttcccgctacgcggttaagagattcttgatctgcccagtcgtaacgaccgcccagggtgaccagcactttatcccactgcgcctgatcctgaacataaacgcccgtttgcttctgcttattcagaatgcggtacggcccggagttatccgggtctttcgcattgaagtcaaaatcggtattcaccggattgtacagatcgagcagtggcacagagtcgtcgtaaccaaaccaggcgttgatgtcattacgcatacgcataaagtcgacaccggtcagcagagtgtggtcgatatcgccagtggcaaacttgctctgcaactgggtatcaacggagaagttttgcagcttctcatcatcaacgacgtatttacgtgccagataatggcctttatccgctggcgctaatgccgcacactgtttgctgtaagcattcgccggatcggagcagacgccgtaaccataaacgctgttttgcgaggttttgttttcagcaaagcgcaggttctgacgcacagtaaaggtatcgttaaattcgtgatcgaagctgtagccgaccatcttctcgttacgagaataggtgttgttcttcgccccttcgttaaagtctgtcggcagacgcttaccgttcggcagcggctcaacggttccctctttcggcaaccagccgtaataaccagtttccggctcgttctggaagtaagaaaggaaggtgaaattggttttatcatccggacgccaggtgaacgccggtgcaatagcataacgctgctcttctgaccctttctgctgggcattggcagaacgcgcaagaccggtcaggcgataagaataaacgccgtcatcatccagcgcatcgctgaagtcaaaaccggtctggaacaggctgtcagtaccggctttaaactgaacttctttcagcggttcggtggtcggacgcttgctgaccatattcaacagaccgccaggactgcttttaccgtaaagcacggaaaccgggccacgcataatttcagcacgttccagcatatacgggtcgatgaccgcatcgttatagaagttgccctgcaacttcaggccattcagatagttattctggctttggccttctgccgcaaaaccgcgaatgatcaggtggtcataggtgttggatgcgccacgcgtaccaacagagacacccggcgtatagctaagcgcttctttcaccgacttaggctgatgcagcgccatctcttcagcggtgacgacagaaatagattgaggtactttttgaatcggcgtatcggttttagtgccggtagctgactgtcgcgccgcaatagttgcagccggcccccatgcgctttcttgcggcgcaggtgcagcggtaacggtgatagtgtcttctttcggttcaaccgctgcctgtgcataaacagacatgccgctaaccgctgtggctactacaactgcgattttacgcagtgagtgttttggctgagcagttttggaaggtgccattggtatttctctggtgtaaagtgaatgataacgtaaacgagaatgattattataaagatgagataatattcgaaacgctggcgggttcgcaagcggtacgcaatctgcgcattcctgaagggtcaataaacaatcagatgaaaagaaagggttaatactttggaggggatgttattttaccggatggcagctcgccatccggtatatcacgcttagacgttaattactcccaaacatatctttaatccaaccggctacaccgtcgctgtctttctgctcttgctgagcaggttgctgttgcggctgttgctgcggctgagaagactgatcaaacggattgcctgacggttgctgctgcatctcactctgctggcacagcgattgcggatcgctggtccagaccggcaagacacgcataccaccgctgcaaacaaagttgccgtcgtagtccacgcccatatctgcaatatcttccggcggaacaagattcagcggtgttggcgtctggttagccagataacgctgataaatcgacattgccccgctggcaccatacagtttggtcggctggttgttatcacggccgacccaggtgatggtcaccgtgctcccatcaatgcccgcaaaccaggtatctacgttattgttggtagtccctgttttccctgccagatgcaggttcgggtatttcgccccaagctgacgacccgtaccgcgttgtacaacctgctgcatggtccatagtgtcagatacgccgcctgcgccggaacagcgcgttccgcctgcgggaagctctgatacaacaccttgccgtcttctgcgatgactgaacgtagcgcggaaagcggagcacgattaccaccgctggcgatagtctggaaggcctgcgccacttcgattggcgttaagttcaacgcccccaacaacattgctggaactggattcagttgatctttcggcacacccagtttaatccaggtctccgtaaccgcaggtagccccaacgccatgcccagattcaccgtcggcacgttcatcgaacgggtcaacgcatctaccagcatcaccctgccactttcgctataacgacgatcatcgttctgcggtgaccagacctggccattcggctgacgcagcgcgattggcgcatcggcaatccacgtattcaaacgatagattttcggctggcttaaggccgttagataagtcgctggttttgcaagggaaccaatcgaacgacgcgcctgcatcgcacggttgtagcccgcaaactgcggctcagaaccaccgaccatcgcacgaacttcaccgctaaagcggtcaacaaccacaatcgcggtttcaagatcgctcaacttacgctgtttcttcagtgccggaatgccttccacggcggctttttctgccgcgtcctgggccaccgagtcaaaggtagtgaagatcttcacgccggagagatcttttaccttatcgcctaatttcgcctgcagctcctgacgcaccagctgcataaaggctggctgaggagagatcaccccaccgcgcggctgaacacccagcggacgcgcactcagcatgtcgtagagttcttgatcaataatttgttgctgttgcagcaaacgtagtaccaggttacgtcgctccagcgccagtttcgggttacgccacgggttgtagatggacgcccctttcaccatacccaccaacagcgcctgctgatcgaggctcaattcttctaccgggcgaccaaagtaatacaagctcgccagcgggaagccgcggatttcgttgtcgccgctctgaccgagatacacctcgttcatatacagctcaagaatacggtctttgctgtaacgcgcgtccatgatcagcgccatgtaggcttcgttcgctttacgccagtaagaacgctcgctggagaggaacaggtttttaaccaactgttgcgtcagcgtactcgccccctgcaccgtgcgtccggcagtcaggtttgccagcaccgcacgtccgattgagtagagactgatcccatcatgctcgtagaaatgacggtcttctgtcgccagcaaagtatccaccagcaaatccgggaaaccactgcgcggcacaaacagacgctgctcaccgtttggcgaagaaatcatggtgatcaggcgcggatcaagacggaagaaaccgaactgacggttgttctccatattgacgatcgtcgccagatgatcgccatcaaaggtcagacgcgcgcgcacctgcccttctttgctgtccgggaaatcaaacggacggcggatcatctcaatgctgttggcctgtacggtaaactcgccaggacgggtcattttcgacacctggcgatactgggtcgcctccagcagcttcaccatctcgttcttgctgatggtcatgtctggctcaaggttgaccattcgaccataaactgccgcgggcaattgccagaccttgccatcaatacggctacgaattttttgatcgagataaacgccgtaaatggcgatcagcacggcaaaaacgatagccagttttagcagcagccatagccagccgcgtttgccacgaggcttacgccctttgcctttgcccttacctttgcgcggcatcggttcttcatcctcatagtcatcataatcgtcgtaatcatcgtcatcttcgtaacgacgacggcttaccttttgtttgaccggacgcgtcggtttccctttgcgtccaattggctcgcggtcattcccggccatgctttttctccgcaatattcaggcgcaaaagcccgattttctgttcttctgttgcaagacagaagaagatatctctcaaatttgctttggtcttcacgaatactttttcgttcgtcgcgtcggtgcggtgtttgccgggtcgtccggccagacatgtttgggataacgccctttcatctctttttgcacctcacggtacgctcctttccagaaggcgctcaaatcacgcgtgatttgcagcggcctttgggcaggggaaagcaactccagcaccaacggtacgcgcccctgggcgatagtcggattagtggcctcaccaaacatctcctgcattctcaccgccagcgcgggcgggttatcttcatggtaacgaatggcgatccggcttcccgtcggcacagtgtaatgcgcaggcaattcactatccagacgttgctgcattacccaatcaagtaatccacgcagtgcctgataaatatcgagtgatttcaggccgcgtagcgaatgtacgcctgtcatatgcggcagtagccacgtttccagcgtcgccaacaaactttcatcatcaaccgctggccagtcatattccggcaaccactttgcggcgcataacaaacgcaagcgtagctgttccgcttccgccgtccagttgagcacgcttaaacctttatcacgaatgccgttaagcatcgcctgatacaactcgtcttccgagggtttcgccagcggttgcactttaaccatcaactgaccaatttgcagccgacgccaggctttcagcgtaccttgcgcgtcatcccactccacagtgtcagactgctgtaccagctgcgggcagcgttgtactaactcatcaatatcgaccggcagcgccagtaaaatccgtgcatccggtgaggcgctgccctgcaataataacggtgcgatcaaccattcgtggcggcttagcgcatcgtcggcatcgagcatcgcccccatgccgttcgccagttgatagcgttcatcttgcccacggcgacgagcaatgcgatcggcatacgctctggcaagtagcggcgcgataagcgaactgtctgcctcaccgccgcgtacgtttaagcgttttaacagttgctgactacgttgctgccaggcgggttgattgcgcgaaaacgccacgcccaggtcactattgcccatccgtggcggctcttcgagaatggcggcaatttttgccgcggtagcagcttcgtcgtcgttcttcgcgctaaccagcattgccgctaaacgcggatcgttacccagcgctgccattttttgcccttgcgcgcttaggcgttcgccatccagcgcccccagcatctgtaacaggcgtttcgcggccagtagattcaccgttggcggttgatccagccagctcatctgcgccggatcgccgcatccccattgcagtaattccatcagcaaaccggaaagatcgctttgtaagatctccggttcactttgcgcggcagcgcgttctgcttgttctttggcgattaaatgcaggcagatacccggctccagacgcccggcacgcccggcacgttgcgtcatcgacgcctgactaacgcgttgagtaatcaaccgcgtaagccctgtacgcggatcaaaacgcgccaccctttcctgggcacaatccaccaccagacgaataccttcgatggttaaacttgtttcagcaatattggtcgccagcaccactttgcgcatcccttgcggtgccgggaggatcgcttttcgctgatcgttcagcgacaacgcgccatacagcgggcagagcaacacatcactgccgatgcgtgaagtcagttgttcctgcacacgctgaatttctccgacgccaggtaaaaataacagtaatgatccactttcctgacgcagcatttcggcggtagcaaccgcgacggcttcgtcaaaacgctgatgagcgggcagcggcaaataacggcgttcaaccggaaacgagcgcccttctgagatgacgacgggcgcttctggcagcatttgctgcaagcggtcgttgtccagcgtagccgacataatcagcagtttaaggtcatcacgcagaccttgttgcacatcgagtaacaacgccaatgccaaatccgcctgcaagctgcgctcatgaaattcatcaaggatcaccaatccaacaccactcagttccgggtcacgctggatcatccgcgtcagcacgccttcggtaaccacttccaggcgggtattcggcccgacgcagttttgcgcacgcatccggtagccaacggtatcgcctggcttttcgttaagcagctccgccagtcgttgcgcaacgttacgcgccgccagacgacgcggctccagcaggataattttcccgttaatgccgggatgcgccagcagttgcagcggcagccaggttgatttcccggccccggtcggcgcacttaataacacctgcgatgcaccatcgagggcagcaagtaactcaggtaagacggcagcaacgggcaacgacgacacaaaacgctccagagggttaacattcttcgcgccacattgtagcatcgcggtaattcataaccgagtgcctcacatgtctgaaccgcaacggctgttctttgctatcgacttacctgcagaaatccgcgaacagattatccgctggcgcgccacacacttcccacctgaggcgggacgtccggtcgccgccgataatttgcatctgactctggcatttttaggcgaagtgagcgcagagaaagagaaggcgctttctcttttagccggacggattcgtcaacctggtttcacactcacgcttgatgacgccggtcaatggctgcgttcgcgtgtggtgtggttagggatgcgacagccgcctcgcggcttaatccagctggcgaatatgctccgctcacaggctgcccgcagcggttgttttcaaagcaatcgtccgtttcatccacatattaccttattgcgcgacgccagcgaggcggtgacaatcccgccgccaggttttaactggtcgtatacggtgacggagttcaccctttacgcctcctcgtttgcccgtggacgcacacgctacacgccgctaaaacgctgggcgctaacgcaataacaaggattgtcgcaatggaattttctccccctctacagcgcgcgacgctaattcagcgttacaaacgttttttagccgatgtgatcacacccgatggtcgcgaattaacgctacactgcccgaatacgggtgcgatgaccggttgtgcaacgcctggcgataccgtctggtattcgacttcagacaacaccaaacggaaatacccacacacctgggaattaactcaaagccagagcggcgcaattatttgcgtcaatacgctttgggctaacaggttgacgaaagaggctatccttaatgaatcaatttcagagctggcaggctatagctcgctgaaaagcgaagtaaaatacggcgccgaacgcagccgtattgactttatgttgcaggcggattcgcgtccagactgctatattgaagtgaaatcggttacgttagcggagaacgaacagggatattttcccgatgcggtcactgaacgaggtcagaaacaccttcgggagttgatgagcgtagcggctgaaggccagcgtgcggttatctttttcgccgtgctgcattcagccattacacggttttcacccgcgcgccacatcgatgagaaatacgcgcaactattgtcagaagctcaacagaggggggtagaaattctggcttacaaagcggaactttctgccgaaggcatggctcttaaaaaatcactaccggttacattgtagtagagtaagtaactggttaatttacattctggtcgcgtgcgcaaatacgcttttcctcacacagttgtcaagtgttacgtttagataattgctatccggaaaagcatctgctatttatagcggcctcatttttcccccgaacatggggatcgatagtgcgtgttaaggagaagcaacatgcaagaagggcaaaaccgtaaaacatcgtccctgagtattctcgccatcgctggggtggaaccatatcaggagaagccgggcgaagagtatatgaatgaagcccagctggcgcacttccgtcgtattctggaagcatggcgtaatcaactcagggatgaagtcgatcgcaccgttacacatatgcaggatgaagcagccaacttcccggacccggtagaccgtgcagcccaggaagaagagttcagcctcgaactgcgtaaccgcgatcgcgagcgtaagctgatcaaaaagatcgagaagacgctgaaaaaagtggaagacgaagatttcggctactgcgaatcctgcggtgttgaaatcggtattcgccgtctggaagcgcgcccgacagccgatctgtgcatcgactgcaaaacgctggctgaaattcgcgaaaaacagatggctggctaattacagccgttccatcacgtttaccacaggcgggaaatgctcccgccttattttttgttcaaagagatgacagacacacactatattggccgcttcgccccctctccttccggcgagcttcattttggttctctgattgctgcgcttggcagctatttgcaggctcgcgcccggcaaggtcgctggctggtacgcattgaagatatcgacccgcctcgtgaagttcccggtgccgcagaaactatcctgcgccagctggaacattacggcctgtactgggacggcgacgttctctggcaatcgcaacgtcaccacgcctatcgcgaagcactcgcctggttacatgagcaaggactaagttattactgcacctgcacgcgtgcgcgtattcaaagcattggcggtatttacgacggtcattgccgggatttgcatcatggaccagacaacgccgcagtacgtatccgccagcagcatccggtcacccagtttactgacctgctgcgaggcattattcacgccgacgaaaaactggcacgggaagattttattattcatcgccgtgatggtttgtttgcctataacctggcggtggtggtggatgatcacttccagggcgtaagcgaaattgtccgcggggcagatttgatcgaaccgacggtgcggcaaatctcgctgtaccagctttttggctggaaagtgccagattacatccatttaccgctggcgcttaatccacaaggcgctaaactttccaagcagaatcatgcgcctgcgttgccgaaaggcgatccgcgcccggtgttaatcgcggcacttcattttctgggtcagcaggtagaaacacactggcaggatttcagcgtcgagcaaatccttcagtcagccgtcaaaaactggacgctgaccgccgtgcctgagtcggcaattgtaaattcaacattctcaaatgcgtcatgctgagctatgattagccgctatttttttgtcctgaatgatgtttgacactaccgaggtgtactatttttacccgagtcgctaatttttgccgcaaggtgctaagccgcgaggaaagcgaggctgaacaggcagtcgcccgtccacaggtgacggtgatcccgcgtgagcagcatgctatttcccgcaaagatatcagtgaaaatgccctgaaggtaatgtacaggctcaataaagcgggatacgaagcctggctggttggcggcggcgtgcgcgacctgttacttggcaaaaagccgaaagattttgacgtgaccaccaacgccacgccagagcaggtgcgcaaactgttccgtaactgccgcctggtgggtcgccgtttccgtctggctcatgtgatgtttggcccggagattatcgaagttgcgaccttccgtggacatcacgaaggtaacgtcagcgaccgcacgacctcccaacgcgggcaaaacggtatgttgctgcgcgacaacattttcggctccatcgaagaagacgcccagcgccgcgatttcactatcaacagcctgtattacagcgtggcagattttaccgtccgtgattacgttggcggcatgaaggatctgaaagacggcgttatccgtctgattggtaacccggaaacgcgctaccgtgaagatccggtacggatgcttcgcgcggttcgttttgccgccaaattgggcatgcgcatcagcccggaaaccgccgagccgatcccacgcctggcaaccttactgaacgatatcccaccggcacgtctgtttgaagaatcgctgaaactgttgcaagcgggctacggttacgaaacctataagctgctgtgtgaatatcatctgttccagccgctgttcccgaccattacccgctacttcacggaaaatggcgacagcccgatggaacgcattattgagcaggtactgaagaataccgatacgcgtatccataacgatatgcgcgtgaacccggcgttcctgtttgccgccatgttctggtacccattgctggagacggcacagaagatcgcccaggaaagcggcctgacctatcacgacgctttcgcactggcgatgaacgacgtgctggacgaagcctgccgttcactggcgatcccgaaacggctgaccacgctaacccgcgatatctggcagttgcagttgcgtatgtcccgtcgtcagggaaaacgcgcatggaaactgctggagcatcctaagttccgtgcggcatacgacctgttggccttacgagccgaagttgagcgtaacgctgaactgcaacgtctggtgaaatggtggggtgagttccaggtttccgcgccaccagaccaaaaagggatgcttaacgaactggatgaagaaccgtcaccgcgtcgtcgtactcgtcgtccacgcaaacgcgcaccgcgtcgtgagggtaccgcatgacagtggcgtatattgccataggcagcaatctggcctctccgctggagcaggtcaatgctgccctgaaagcattaggcgatattccagaaagccgcattcttgctgtttcttcgttttaccgcaccccaccgctggggccgcaagatcaacccgattacttaaatgccgccgtcgcgctggaaaccactcttgcccctgaagagctactcaatcacacacaacgtatcgaattgcagcaaggtcgcgtccgtaaagctgaacgctggggaccgcgcacgctggatctcgacatcatgctgtttggtaatgaagtaataaataccgaacgtctgaccgtaccgcactacgatatgaaaaatcgtggctttatgctgtggccactgtttgaaattgcgccggaattggtatttcctgatggcttatcattagttgaagctctacaggcaaaaggctttaatgaattagataagtggtaattatttttcgtgtgaatataaatatattctgaaaatagcctcaagatattgcaaataataatatatttaagataaataaaaacacagaaaatataatataatttcctgaacttctaattccatacaccaccccccttaatttttaaagttaattttactaatttttatgtttagtaaaattaacttccatatgtcatgatattatgcagaatgtctgtccaatgatgaatgaatgttatacttggtaaaaaacaaacagacatcattaacaaagtaacgttcagttacatggcattgcatcaaaatctcatcatcatgcaatgctgttatctgctttatggaatattgataaaggatttttatgtctaaaaaattaggttttgtgctgtccggtattatgttggcaatggctgctggtactgcatttgctgctaacgatatggacggtggtcagttaaatattagcggcctggtcgttgataacacctgtgaagctcgtgttgatggcggtaacaaagacggtctgatcctgctgcaaactgctaccgttgctgaaatcaccgatggtgtactggataccaccgtaggtgctaaagctaaaccattcagcattactattgactgtagcaaagctaacccggctccgggtactactgcaaaaatgaccttcggttctgttttctttggtaacagcaaaggaacactgaacaacgacatgtctattaacaccccgtctgacggcgtaaatatcgctctgcacaatattgaaggttctattattaaacaggttcaggtcaataatccgggtgatgtttacagcaaaactctggattcaacgtctaaatctgcaacctacgattttaaagcatcctatgttcgtgcggatgcaagcaaagcagctactgccggttatgtaaaaaccaactcagcatataccattacttaccagtaaatatcaaccgcttaaattgatcggatgaatatatacagggaataacatcaaatatttttacttttgataattattccctgttttaattaattctgtaaggaatggtttatgttttttaatactaaacataccgcagcattgtgcttagcgagctgtatggcttttagctcatcagctattgcagacatcgtaatttcaggtacacgcgtagtttataaaagcgaacaaaaaaacgtcaatgtacgtctggaaaataaaggcaataacccattgctggttcagagttggttagatactggcgatgacaacgctgaaccaggcagtattactgtcccctttaccgctacgccgccagtatcacgtattgatgctaaacgtggccaaacaatcaaactgatgtacaccgccagcagtgctctgccaaaagacagagaaagtgtgttctggtttaacgtactggaagtacctccaaaaccagatgcagcaaaagcagcaaaccaaagcctgctacaactggcatttcgcacacgtataaaactgttctatcgcccggaaggattgagtggaatttcatctgatgcaccattggctctgaagtggtcctgggcaacatctgaaggcaaagcagcattacgcgttgataaccctacgccctactatgtctcttttagcagtggtgatttagaagccaacggcaaacgctaccccctggatatgacaatgattgcgccgttcagtaacgacgtcatcaaggtaaatgggatgagtggcagaacaagctctgcaaaagtgcattttttcgccattaatgattttggtggatctattgaaggcaacgccaacctttaatctggcaaggatataacacagcaggaagcagaacgtgactattaaatctactaatcaccttacccacatcgccacgttttgcgctctgctgtatagcaatagtgctttatgcgctgaactcgtcgaatatgaccatacatttctgatgggaaaggatgcttcaaatatcgaccttagtcggtatacagaaggcaatcccacactacctggcatttacgatgtcagtgtgtatgttaacgatcaacccatcatgagccaaagcattgcttttgctgttattgaaggtaaaaagaacgctcaggcctgcattacgcagaaaaatttattgcaattccatatcagttcaccagacaagaatagcgaaaaagccattttgcttaagcgagacgaagatcttggtgattgcctcaatctggctgaaatgatccctcaatcatccattcgttacgatgttaacgatcaacgcctggatatcgatgtcccccaggcatggattatgaagaattatcaaaactatgttgatccctctttgtgggaaaatggcattaatgcagccatgctttcctacaacctcaatggatatcacagtgaaagtccaggcagaacaaatgacagtatctatgcggcattcaacggtgggataaacttaggcgcgtggcggttacgtgcctcaggtaactacaactggatgaccaatgtccatagcgattacgattttcagaatcgctatttacaacgcgatcttgcgtcactacgttcacaactggttattggtgaatcttacacgaccggcgagaccttcgattcagtcagcattcgcggtattcgcttatacagtgacagtcgaatgctgcctccggtattagccagttttgcgccaatcattcatggcgtagcgaataccaatgccaaagtaaccgttatgcaaaatggttataaaatctatgaaacgacggtgccgccaggggcctttgccattgacgatcttagcccgtcaggttatggcagcgatctcattgtgactatcgaagaagctgatggcacaaaacggacgttctctcagccattttcatctgttgtgcaaatgctgcgccctggcgttggtcgctgggatattagcgccggtcaggttttaaaagacagtatccaggatgagcctaatttatttcaagccagctactactatggtttgaataactacctgacaggatataccggtattcagctaactgataataactacaccgccggattgctggggcttggtatgaatacccccgtgggggctttttctgtcgatgttactcactcaaatgtcagcattccggacgataaaacctatcaaggacaaagctaccgtatttcctggaacaagttatttgaaaataccagtacatcattaaatatcgcggcctatcgctactccacccagcactatctgggcctcaatgatgcgctgacgctgattgatgaagtagaacatcctgagcaagagcttgaacctaaatccatgcgcaattactcgcgcatgaaaaatcaggtcacggtcagtatcaaccaaccgctgaaatttgagaaaaaggattacggttcattttatctctcgggaagctggtcagattactgggcctccgggcaaaacagtactaattactctattggttatagcaatagtgcgtcctggggcagttacagtatcagtgctcaacgttcgttgaatgaagatggtcaaaccgacgatagcatttatctcagcttcacgattccaatagaaaatttactgggtacggaacaccgcagctccggcttccagagtattgatacacaattaaacagcgactttaagggtaataaccaactcaatatcagcagtagtggttacagcgataccaatcgcatcagctacagcgtaaacacgggttatatgatgaataaatccagtgatgatttgagttatatcggcggttatgccagttatgaatcgccgtggggaacgctgtcaggttcagcctcagcaagcagtgataatagtcgccaattctcactcaatactgatggtggatttgtgttacatagcggcgggctgacgttcagtaatgacagttttagtgattccgacactctggctgtcattcaggcgccaggagcaaaaggcgctcgtattaactacggaaacagcaccgtagaccgctggggttatggtgtgaccagcgccctttcgccataccatgaaaatcgtatcgcactggacattaacgatctggaaaacgatgttgaattgaaaagcaccagtactgtcgccgtcccgcgccagggagccgtcgtctttgctgattttgaaacagttcagggacaatcggcaattatgaacatcgtgcgaagcgatggtaaaaatattccatttgcagcggatatttatgatgaacaaaacaatatcatcggcaacgtaggtcagggtggtcaggcctttgttcgcggtatcgggcaggaaggaaatatacgaattacctggattgaagagggcaaaccggtcagttgttttgctcattatcaacaaaacacgacatcagaaaaaatagcacaatctattattctgaacggacttcgttgtcagatacagtaaccacaagggacttccaatgataaaaatcacaccacataaaataacaatactcatgggactattgttatcgccttcggtatttgcaacggatgttaatgtcgattttaccgctaccgtgaaagcaacaacctgtaatattacacttaccggaactaatgtcactgataatggaaatgataagtacaccttagttattccctcgatgggaatggataaaatagccaataaaacagcacaatctgaagccaactttaaattggtagccaatggatgcagcagtggaattagctggattgatacaaccctgacaggaaatcaatcaggaagttcacccgcgctaattatccccctggccagtgatacaacctccaccacaagctatatcggaatgggatttaaaaggaaggcgacttcaggcgatacatttctgaaacctaatagcgcagaatatatacgttggagtgcatcagaaattagcaccgatggacttgagatgactgtcgcactgcgtgaaacaagtgtagggaaaggtgttccaggcaagtttcgcgcactggcaacttttaacttcagctatcaataacaaggatgacaatgatgatattaaaaaaattatgttatggattatcgggtagtctatttctggcttcatcactgttaaccatttcctcacatgcggccactgacagtattggcctgactgttactactgacgtagaaatgggtacctgtacatcaacgttgactgatgacggtacaactaaaatttccaccatcaatttcggtgatgtatatatttctgaaattaatgccgaaactaaaattaaaaccttcaaattacagttcaaagactgtgcggggattcccgggaaaaaggccaaaataaaattgactacacgagcattatgtgaaggtaattctaataatggtcctggatttgctaacgcatcaacggcaacagcaaaagcagcggcggtcgccgttgaggtctggagcacatccacaccaggtaagaacggcgctaaacaattcagttgtgtcacccccgcaacagaagaagtcagtattgctaatgcgacgggcagcaatgttgtcgattacccaatgagtgcggtgttggtggtcgcaaaagataaaactgtcacaaatgtcactgcgggtgatttcactgccccggcaacattcaccgtgacttataactaacaggcagactgattcaggaactaaatatgcgtcccactcaacgtaatctgatgaaaaaatcaattctgattctgtcgttgctattcagcgccacttcccctgtggttgcaggacaggatgttgacattgttgcaaatataaaaaataacacctgccaaagtggaatcagcaacaacggaaatattgatttaggtgtcgttggcgtgggcgattttaccggaaacatttcagccgaaaattatcaccccggtggaaaagagttcactattacagtacaggactgcacacttcagggcacagggaatgtgttaaatcagttacatattaattttcgcgcacttagtggcgtaatggcgacaggttccagtcaaatattcgctaatgaagacaacgccggggctaaaaatgttggggtagttatattttctattcaggacccggcaaataccttcaacgttcttagtgccactggtagctcacgttccgtttatccggtcatgtcatcagcactaaataattcatcctggaaatttagtacccgaatgcaaaaaatcgatccagcactgaatgtcacctctggcccactgataagccatgtgttagtggatatctactacgaataacagacaaagtgctacaagtattatcttgcagcatgacaatggagtaaaaatgaagacattcttcagatactttctttttttagcactatgctcttgttgttatacagcaagcgccggcaccgatgatgacgtcggctatattgttgggaataattacggtgttggtccatcagaccaaaaatggcgagagacaggtcccaatggagatgttaccgtcaaattccggtatggttcaggcaccaataatttagttttttataaaccaacccaacttggcccaaccggggtgtcattaaaatgggcgcagttagattccgcttcgggtggaggtttcctttactgtaacaggagtagtaactcaagcggcgcaccaatgtctattgaacataaaatggttgattccggaaaaagttatggcggacataaactctttaagacatctgttccaggcctgtattacacgttagcaatatcaaacatttggtcaacacttacatctactgatatcaacccatcaggcatgtatattggcgattctacgagccaatcttttaactggcgtggcgaaagcgagcaaaccctatattggtcttgcaacaacgcgaatagcagcaaaaaatactgggccgttggtggcgttatgcaaacgctcacgattgaattttataccgataccgactttaacccgacaacgaatcaacgggtaacattatccagaacagatagttatctctactcattcaaagcatataatgctggcggtagtatcaagagttattttcttaaaatcgactttgacttgacagatatcgtattaacaaaccctacctgttttactgctgcgcttagtggcccatcggtaagtggttcaacggttaaaatgggtgattatagccctgcacaaataaaaaatggcgcaacagcggttccttttgatatcacgctacagaactgtattcgtgttcgcaatatagaaacaaaactcaagtcaaacaaggtgggtagtgtaagcaaagaacttttggctaacacactcacaggaaatgacgcagcaaaaggcgttggtgtactgattgaaggtttaaaaaacactaaaagtgcacaaatggtactgaaaccaaatgatgcaacgtctatttataaagattatgaaacagaaaatgacactactggggggattttcccggataatggcaacggtgggacctctcaacctcttcatttccaggctacattaaaacaagacggtaatattgctatagaaccgggggattttaaagccaccagcacttttcaggttacctacccctgataacactatcgcaccgccagacaacggcggtgcgatacggataaatcattgcccccaccaatgtgactgataaaatgcgagacagcacaacatcatttatcaggatacgctatgaaaccaaccacgattgcttcattgcagaaatgcaagcaggacaaaaaacgtttcgcaaccatcaccgcttacgactatagcttcgcaaaactgtttgccgatgaagggattaacgtcatgctggtaggcgattcactgggcatgacggtccaggggcatgactccacgctaccggttaccgttgccgatatcgcctatcacaccgccgctgtgcgtcgcggcgcgccaaactgccttctgctggctgacctgccatttatggcgtatgccacgccggaacaagcctttgaaaacgccgcaacggtaatgcgtgccggagccaacatggtcaaaattgaaggcggtgagtggctggtggaaaccgtacaaatgctgaccgaacgtgccgttccagtttgtggtcatttaggcctaaccccacagtcagtgaatattttcggtggctacaaagtccaggggcgcggcgatgaagcgggcgatcgactgctcagcgatgcattagccttagaagctgctggggcacaactgctggtactggagtgcgtgccggttgagctggcaaaacgcattaccgaagcactggcaatcccggttatcggtattggcgcaggcaacgtcactgacgggcaaattctcgtgatgcacgacgcgttcggcattaccggcggtcatattcctaaattcgccaaaaatttcctcgccgaaacgggcgacatccgcgcggctgtgcggcagtatatggctgaagtggagtccggcgtttacccgggcgaagaacacagtttccattaaggagtgacgttgtgttaattatcgaaaccctgccgctgctgcgtcagcaaattcgccgcctgcgtatggaaggtaagcgcgtggcgctggtgcccaccatgggtaacctgcacgatggccatatgaagctggtcgacgaagccaaagcccgcgccgatgtggtcgtcgtcagtattttcgttaacccaatgcagtttgaccgcccggaagatctggcacgttatccacggaccttgcaagaggactgcgaaaagctgaacaaacgtaaagtggatttagttttcgcgccttcggtaaaagagatctacccgaacggtactgaaacccacacctatgttgatgttcccggtctttccaccatgctggaaggtgccagccgtccgggacattttcgcggcgtttcgactattgtcagcaagctgttcaacctggtccagccagatatcgcctgcttcggtgaaaaggattttcagcaactggcactgatccgcaaaatggttgccgatatgggcttcgatattgagattgtcggagtgccgattatgcgcgcgaaagacggtctggcgctcagttcccgtaacggctatctgacggcggaacaacgtaaaattgcgccgggtctctacaaagtcttaagttcaattgccgacaaattgcaggctggcgaacgggatctcgatgaaattattgctattgccgggcaagaactgaatgaaaaaggtttccgttccgatgatattcagattcgcgatgccgacaccttgctggaaatctctgaaaacagcaaacgagcggtgattctggtagccgcctggcttggcgatgctcgcctgatcgacaacaaactagtcgaactggcgtaatgcttaactggcgctacggctgatggcgccagttattcattgccacgttatctgtaggcaattattcatatcgtagacaacttagttagagttaattagcttatcaatctctgcaagagataaagctgtcacctctgcaacgtcttcccgagacattcctttactcagaagacgctgggccagtcttaccttctggagtccctctttatatcccttctgaaatcccttctcttcaaaccactgcgccaacgtctgcctggtttctctccgtgtctttatttccatatgttcccttaattatctggtcagttaacaataacaattatctggctataactgataatgcagataacttagctaatcagcttatcaacctcagcaagaggtaaatttgccatctctgcaacgtcttcccgagacatccctttactcagaaaacgcagggcgtattcctgtcttacttcctgtctaacctcttgtattacctcctgtcttacctcctgtcttacctcctgcctttcctcctgtcttcccttctcttcaaaccactgcgccagcgtcatcatagactcccctcccgtttccctgtctctcaccacaccataaaacaaatccgcttgttcagtatgaccgcgttgcagcatatagttttgcatggcaactaactgacttccgctagtgtacccttcgtcaatcagcgtgaccagttgctccagcaataacattaagtcgcgctggcgaatatgtttttgcagcagttcgagaatcgcaatccgccgatgttgcatgatttcgtcatccggtgtgatagtgatatccaccagcgggaaaggattgttatagacgcgtcgcgccagttccggtgagtaaaacatatcaaaccagcacattgatagcggataaggtgtggcctcgccctgataaaacagaattggcaccaccagcggcagcttatcgtggtcagcctccagatgccggtgcatggcagcaatagaataacgcatcatgcgaaaggccattttcttatccggcttgctttgatgttcaatcacaacatgcaaataaccggggttgccctgcatttgcacggaataaagcacgtcagtgctgtgccctttcaggctttcttcaataaaactccccgactcaagatgcagcgtgtcgaggtcacacagttcgcgtagctccgctggcaaatggatatccagaaagtcgcgagccgtttccgcatgcattaaaaaatgtttaaacaccgcatcatgcggtgtggtactcggtgcatccatcttccctgccttccgtgtggtcttgcgtgaaggcagtatccagtcaaggtgtgccgtcgtcagccgcctctttagtgtttaccgagcagtgttcagataaatttcaattggttacaggcgttacatggcacgcttcggcacggtacgcaaactgctgctgcaaatgccgtcagatgagtagacactaaacaaaaatcgggcaatactgcgtgagaatttcctcaaagcaggcatcgcctgcttcgttaacgacagggtagaaaggtagaagttatgattcgcacgatgctgcagggcaaactccaccgcgtgaaagtgactcatgcggacctgcactatgaaggttcttgcgccattgatcaggattttcttgacgcagccggtattctcgaaaacgaagccattgatatctggaatgtcaccaacggcaagcgtttctccacctatgccatcgcggcagaacgcggttcgagaattatttctgttaacggtgcggcggcccactgcgccagcgtcggcgatattgtcatcatcgccagcttcgttaacatgccagatgaagaagctcgcacctggcgacccaacgtcgcctattttgaaggcgacaacgaaatgaaacgtaccgcgaaagcgattccggtacaggttgcctgattgttatccctgcggctggttactcaccagccgcgacatcgtctccagcgaatccgttcttaagatataaagtcgttttagtaacaacggattatcccccggttttactttgcctttcatggtcgtcaccgccaggtgaaatccggcttcttttgctgccttcacggctttgtcattaaatccgccaaatggataagaaagatacaaaacatgtggattaaattgcgccagagcgcggcgtgaacgtgcaaaatcaaacagaatattgtgctcactacggctcagcaatataggccgccgataaccatctatccgatgcaaaaaatgagtatgtgactggaaatcaaatacatcgcgaatttcgttaagttcagaaacgctcataaattgcagcgattttgggttccatttctgcgggtgacgtttgatgcgcgaggtaacaataaacgccgtcgccttcataccatattgtttcaacacaggatacgcatagcggctcaccgacttgaggccatcatcaaaggtaattaccaccgctcgcgcagggagattgatcttattcttcacgtaaccttccagctgcgccatgctcagtgtcgcgtatcccctgtcgcgcagccaggccatctggttattgaaagcgcgtaccgaggtggtcgtcgaagtatggcgaaaacgggtgttttcttcgtcgcgcaaaatatggtgataggttagcaccggcaagccattatcgggttgggcatccagcgcgctgatataggccagtcgatcgccaatgcggatctgataccaggtttgatttaacctgtctttcagtttatgcaaaatcgggtagcgcaaattgtccgccagtactccaaatggcgcactgcccacactcggcgcgttataaaccggcgtatctttccaggttattaagttctgattactcagcggcttgttgaggtcacccaaaccatcttcaactttttgtcgcccctgaaccggctcgagatggcctttatcgataaaccctttaccaaagccaaaattaaatacgtaataacttgcggcagtgggctccacggcaatgatttgcccggcccgaatattccctaccgtcaccattttgtcgccaatttgcgcccagaccgcagcattttcgatggtttgcatataatgagcaggtaatgcggcactgacgcttgcggtaaacagcatcagtaggagaataacagcttgtttgtacatgaaaaaataaccgagggtgaaacaacgcttttattgtagcaaaagcgtcatcagaatcgcgggttaatactcatacaaattatgtttgaggacgaaaggcggatttttttgttgctggtgccaaagactactcacctccggcgcacccagttcgacaatacgctcgcgaaacgctgaactggtcatggtttcacggcaagccatcatctgttcaattaacggtaacgtgacaccagaaatcacttcgcaacgggagtgtttgtggcttaataatgaagccacgcggtacggtggcgctccggctatatcggttaaaaagataacgccctcaccagagtccgtttcatgcaaggcatcgcacatcatgcggctgagcatattagagcttaatccgcgccagaaattcacggcccggcactgaagaagtgccccatgttttttctccagcgcatccagtatctcttgcgcccggtcatcgtgacaggtaattacccaacctaacatcgccttcctccttagccgaaaatcagtctaccctgaccattgttgataaagggtgatagccgtcaaaactcctctcccccaaatccagaggagaggaaatagccttagctacgcaaaccacgtccacgttggatcagcgaccaacagatcaaataaaacgccacaataaagaccaccagtacgccaaaggtagtgaccagcggaacatcattgataccgaggaagccgtagcggaaaccactgatcatataaacgattgggttcaggtgcgacagcccttgccagaacggcggcaacaaagtcagggagtaaaacaccccgcccaaatacgtgagtggcgttaacacaaaggttggcaccaggctgatgtcatcgaacgttttggcaaacacgccgttcagcaaacccgcaagggagaatagcaccgcagtgagcaccagggttaaggcaacgaatacccacgaatgcacctgaaacggcacaaaaaacagtgaaattgccgtcaccaaaataccaacaaacagaccacgcgccacgccaccaccgacatatccggcaataatgacatgagtcggaaccggcgctaccagcagctcttcaatattacgctggaacttggcaccaaaaaatgatgacgcgacgttagcgtaggcgttggtgatcaccgacatcatgatcagccccggtacgatgaactgcatgtagctgaagccatgcatatcgccaatacgcgaaccaatcaggttaccgaagataataaagtaaagggtcatggtgatgactggcggcaccagcgtctgcacccagatacgcataaagcgatggatctctttcgcccagatgctttttagcgccacccagtaaagatgcatcatgtgcgatctccttgtttttcattaaccagtgaaacaaacagctcttccagacggttagctttgttacgcatacttaatacctgaatgccctgctcacttaactgcgtaaatacgctgttgatcccctgctcacgcagcacttcaacttccagcgtggcggtatctaccagtcgatactgatagccatcgagcttcggtaacggacttttcggtgcgagatcgagaataaaggtttctgatttcagcttcgccagcagcgccttcatcgaagtattttccaccaactcaccgtgttgaataatgccgatattgcggcacagcatttctgcttcttccaggtagtgtgtggtgagaatgatggtggtgcctttgtcgtttaaatccttcaaaaagccccacattgagcggcgaagttcaatatccacgcctgcggtcggttcgtcgagaatcagtagtttaggttcatgcattaacgcacgggcaatcattaaacggcgcttcatcccgccagataacatacgcgcacgttcgttgcgttttccccatagatcgagttgtttaagatacttttcgctgcgaatgtacgcttctttgcgctccacaccgtagtaccctgcctgattcaccacaatttgctgcacggtttcaaacgggttgaagttaaattcctgtggcaccagacccaactgacgtttagcgtttacgacatctttctcgagatcgtaaccaaatacgctgacccgcccggaggttttatttaccagagagctgataataccgatagtggtcgattttccggccccgttcggcccgagaagcgcataaaaatcacccgcttcgacctgcaaatcgattccacgaagcgcctgaacgccgcctggataggtttttttaagctgttgaagttccagtgcaatggtcataaatttttacttaccttacgttcttacactttatctgtggtttaaatcgtcccggagttgccctatattagccaaacgtaattatttggttacaggtcgttaacctccatgaaagacatagatacactcatcagcaacaatgcactatggtcaaaaatgctggtggaagaggatcccgggttttttgagaaactggcacaagcgcaaaaaccgcgctttctatggattggatgttccgacagtcgcgttcctgcagaacgtttaaccggtcttgagccgggcgaactctttgttcaccgtaatgttgctaacctggtcattcacaccgacctgaactgcctttccgtggttcagtatgcagtggatgtactcgaagttgaacacattattatctgtggccactacggttgcggcggcgtacaagccgcagttgaaaacccagaactggggcttatcaacaactggctgctgcatatccgcgatatctggttcaaacatagctcattgctcggcgaaatgccgcaagagcgccgtctggataccttgtgtgaactgaacgtcatggaacaggtgtataacctgggccactccaccattatgcaatcagcgtggaaacgcgggcagaaagttaccattcacggctgggcctacggcattcacgacggcttgctgcgtgatctggatgtcacagcgactaaccgcgaaacccttgagcaacgttaccgtcacgggatctccaacctcaagctgaagcacatcaatcacaaataaattcgccatgccggatgcaacacatccggcaacttcacacttactcgtccagcagaatcactttgccgatatacggcagatgacggtaacgctgtgcgtaatcaatgccgtaacccaccacaaactcatccgggatcgagaaaccgataaattctaccgggacgttcacttcacgacgggacggtttatccagcagcgtacaaatcgccaacgacttcggttcgcgcaggcttaagatctcacgcactttcgacagtgtattccccgagtcgatgatatcttcaacaatcagcacgtccttgccacggatatcttcatccaggtctttgaggattttcacatcacgggtggtggacatgccgctaccgtagctggaggcggtcataaagtcgacttcatgagatacctgaacttcacggcacaggtccgccataaacataaatgagccacgcagcagacccaccagcaccatatcgctgccgctgtctttgtaacgctcagtaatctgacgacccagttcggcgatacgcgctttaatctccgcttcggggatcattacttctacagtatgtttcatatctataaccatatgatttaaaaacaaatcacttcgcacgggcaggttttggcaccgcaacaaagcgcaagacacgcagtataccagtaaaactattcattcgcggaatctgttaataaagctcgaattgtgatgacgatcacacatgttaaaacctataattaattgctactaaaatattaatgaattgaaatggtgtctctttatggcaattaacaataccggctcgcggcgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctgtacgcagccctgctgctcggcactatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggaaatcagcggcaccttaagcgccgataccacgccagcagaagccatctcccccgttgccgatcaggactggcctgcctatggtcgcaatcaggaaggtcaacgcttttcaccactgaagcaaattaacgctgataacgtccacaagctgaaagaagcctgggtgttccgtactggcgatgtgaagcagccgaacgatccgggcgaaatcaccaatgaagtgacgccaattaaagtgggcgacaccctttacctgtgtaccgcgcatcaacgtctgtttgcgctggatgccgccagcggtaaagagaaatggcattacgatcctgagctgaaaaccaacgagtccttccagcatgtaacctgccgtggcgtctcttatcatgaagccaaagcagaaactgcttcgccggaagtgatggcggattgcccgcgtcgtatcattcttccggtcaatgatggtcgtctgattgcaattaacgctgaaaacggcaagctgtgcgaaaccttcgccaataaaggcgtgctcaatctgcaaagcaatatgccggacaccaaaccgggtctgtatgagccgacttcgccgccgattatcaccgataaaaccatcgtgatggccggttcagtcaccgacaacttctcaacccgcgaaacgtctggcgtgatccgtggttttgatgtcaacaccggggagctgctgtgggcttttgatccgggcgcgaaagatccgaatgcgatcccgtctgacgaacatacctttacctttaactcaccaaactcgtgggcaccagcggcctatgacgcgaagctggatctggtctatctgccgatgggcgtcaccacgccagatatctggggtggtaaccgcacaccggaacaggaacgttatgccagctcgattctggcgctgaatgccactaccgggaaactggcgtggagctatcagaccgttcaccacgacctgtgggatatggatcttccggcacagccgacgctggcggacatcaccgttaatggtcagaaagtgccggttatttacgctccggcgaaaaccggcaacatttttgtgctcgatcgtcgtaatggtgaactggtggttccggccccggaaaaaccggttccccaaggtgctgccaaaggcgattacgtgacccctactcaacccttctcggaactgagcttccgtccgacgaaagatttgagcggtgcggatatgtggggtgccaccatgtttgaccagttggtgtgccgcgtgatgttccaccagatgcgctatgaaggcattttcacgccgccatctgaacagggtacgctggtcttcccgggtaacctggggatgttcgaatggggcgggatttccgttgatccgaatcgtgaagtggcgattgccaacccaatggcactgccgtttgtttcgaaactgatcccacgcggtcctggtaacccgatggaacagccgaaagatgccaaaggcacgggtacggaatccggcatccagccgcagtacggtgtaccgtatggcgtcacgctcaacccgttcctctcaccgtttggtctgccatgtaaacagccagcatggggctatatctcggcattggatctgaaaaccaatgaagtggtgtggaagaaacgtattggtacgccgcaggacagtatgccattcccgatgcctgtaccggtgccgttcaatatgggtatgccgatgcttggcgggccaatctccacggcgggtaacgtgctgtttatcgccgctacggcagataactacctgcgcgcttacaacatgagcaacggtgaaaaactgtggcagggtcgtttaccagcgggtggtcaggctacgccaatgacctatgaagtgaatggcaagcagtatgtggtgatctccgcaggcggtcacggttcatttggtacgaagatgggcgactatattgtggcttatgcgctgccggatgatgtgaagtaaggcttgctcagattgctgacaacgtgcgatttgttcatgccggatgcggcgtgaacgccttatccggcctacaaaactgacaacgtgcgctttgttcgtgccggatgcggcgtgaacgccttatccggcctacaaaacatttgcaaattcaatacattgcgcgtaggcctgataagcgtagcgcatcaggcagttttgcgtttgtcatcagtttcatgcccggagagatccgggcatatttccgaatacggtctttttataccgtaaaccctaacatcatccccgtatcttcatgctccagcagatggcagtgcgccatataagcatgttctttcggtgcatcgtgattaaacttcaccagcacttcgctgacattaccttctaccttaacggtatctttccagcctgcgcgatgcgtcgctggcggtttgccattttctgacaagatacggaactgcgtaccgtggatatggaacggatgcagcatcatgtcgcccacgccagagataacccaacgttcgtactgccctttcgccgccgcaaacatcggcttattcatatcaaacgcctgaccgttgattttgttggcatggtggaaatcgaacttcccgctgtggttcatatgattcatattgccgtgccccatatggcccatcatctggctgtgatccatcccggccatcgcctgatcgccatatttctccatcagcatctgcatccccatcatatcgagcattgggtccatagaaagttgcagcttgcgtaccgtcagcccctccagcgaaggtaacgcaggcaggctacttaatgtgtctggcaaagcaccagaggcactaatggcaatcggctgaatccgcattaccggatgcggcttgtcaaacggcgtaatcgccatccccatctggctgaccggcagcgtcaccaggtcaaagggtttgttgtcgttaacctccaccagcacttcaaaacgctcgcccatcagcactggcagctcgttcaccttcaccggttcaggtagcagaccgccgtcgctggcaatcacataaagcgggcgattgtcgctggtggcgaaattgagcgagcgggcattacagccattgagcaaacgcaggcgcagccagccacgcggggcagcgtgttgcgggtagattacaccgttggtcagcaacgtatcgccaaaccaacccacagcggcggtcatcacatccagttgataatcaatctgcccgtctgcgttaaattttttatcctgaacaatcaccgggacatcatcaataccccactgttttggcagcattaatttcaggatctcgtcatcttcaatcaccaccaaaccagccagccccatcgccacctgtcgcccggtcttgccatgttgatgtggatggaaccaacaggtagcggcaggttgatcaacgttcaacgtcaccgagcgcttgccacctggcggaataattccctgcgggccgccgtccacttcacccggtacttccagcccgtgccagtgcaacgtcgtctcttccgtcagttggttgtagatatcaaccgttaccgctttgccgcgctgtaatttcaccgccggccccagcagattgccgttatagccccaggtagttgcggttttcccgccaaaggtggactgacctgcgccaatagttaactgaatgcgattacgggcatcggtcgtgagcaaatcagggatcggtaacgttgggcgttccgccgcaaatactgcgcggctccacagcggcaaggctgaagccacacccagcgcgacggaatatttcaagaaatcacgacgttgcatagttatttccttattcttaagcaggcgaaacaaaatcaaacgttgagcatagtccttccccttacgggaaggtcaagccgcagacacaatttaatcgacaataatggtcgtcgcctcgctcgcagtgtgctaacgtttatcttctttaagcccctggtagaagcaatgaagacgtttttcagaacagtgttattcggcagcctgatggccgtttgcgcaaacagttacgcgctcagcgagtctgaagccgaagatatggccgatttaacggcagtttttgtttttctgaagaacgattgtggttaccagaacttacctaacgggcaaattcgtcgcgcgctggtctttttcgcccagcaaaaccagtgggatctcagtaattacgacaccttcgacatgaaagccctcggtgaagacagctaccgcgatctcagcggcattggcattcccgtcgctaaaaagtgcaaagccctggctcgcgattccttaagcctgcttgcctacgtcaaataatccctgatacctttttgtagaaatattgaccgtgcatccgcggtcaatgttagctattatgttgcgccatttttttacgggtgttaacaaaggaggtatcaacccatggccgaaaaaaaacagtggcatgaaacgctacacgaccagtttgggcagtactttgcggtagataacgttctgtatcatgaaaagaccgatcaccaggatctgatcatttttgagaacgccgcatttggtcgcgtaatggcgctggatggcgtagtacaaaccaccgagcgcgacgagtttatctatcatgagatgatgacccatgttccgctactggcccacggtcacgcgaaacatgtgctgattatcggcggcggcgacggtgccatgctgcgtgaagtaacccgacataaaaacgttgagtcaatcacgatggtggaaatcgatgcgggtgtcgtgtcgttctgccgtcagtatcttcccaaccataacgccggtagttacgacgatccgcgctttaaactggtgatcgacgatggtgtcaatttcgttaatcaaaccagccagacctttgatgtcattatctccgactgcaccgatcctatcggtcccggcgaaagtctgtttacttctgcattttatgaaggctgcaaacgttgcctgaatcctggcggtatcttcgtcgcacaaaacggcgtctgctttttacagcaggaagaggccatcgacagccatcgcaaactcagccattacttcagcgatgttggcttttatcaggcggcgatcccgacctattacggcggcatcatgacctttgcatgggcgacagataacgacgccttacgccatctctcaaccgaaattattcaggcgcgttttctcgcttctggcctgaaatgccgttattacaatccggcagtccatacggcagcttttgccttaccccagtatctgcaagatgcactggcttcacagccgtcctaaggagaagataagaaattgaaaaaactgaaactgcatggctttaataatctgaccaaaagtctgagtttttgtatttacgatatctgctacgccaaaactaccgaagagcgcgacggttatattgcttatatcgatgaactctataatgccaaccgtctgaccgaaatcctgtcagaaacctgttccattatcggggccaatattcttaacatcgcccgccaggattacgagccacagggtgccagcgtcactattctggtgagcgaagaaccggtcgacccgaaacttatcgacaaaacagaacaccccggcccactgccagaaacggtcgttgcccatctcgataaaagtcatatttgcgtacatacctacccggaaagtcatcctgaaggcggtttatgtaccttccgcgccgatattgaagtctctacctgcggcgtgatttctccgctgaaggcgctgaattacctgatccaccagcttgagtccgatattgtgactattgattatcgcgtgcgcggttttacccgcgacattaacggtatgaagcactttatcgaccatgagattaattcgattcagaactttatgtccgaagatatgaaggcgctgtatgacatggtggatgtaaacgtctatcaggagaatatcttccataccaagatgttgcttaaagagttcgaccttaagcactacatgttccacaccaaaccggaagatttaaccgacagcgagcgccaggaaattaccgctgcgctgtggaaagaaatgcgcgagatttattacgggcgcaatatgcccgctgtttaacgtctcaggcggagcacggaggctccgcctgatttacttacttctgctgcacgaaattacggtaagccgccaccacctgaagaaaatcctcaacgccgcacagcgacaagctctcttcatcgtagtagttcatcccctcttccatttcatcgccagcgaattccagttgattggcgcgaaccatcacctcttcaccgtccatccatagcgtgtattcatgccctgcccgctgccaggatcgttcgctgcctttgagcgtgcgcgctgcgtcttccacttcatcaagcaaggccaggttttctttcacctcttcattaaaccagtgcccgatgacttcatgccccatggacatgcgcacctttaccactccggtaatatcgcgcagaaattcgtaatccatagtgtgttcctctgctcccggcaatgcgccgaaatcgcattgcgccattgatgtaattatcgcagccttaccggagaaaaacagcggaacggcgatggtttagaaataaaaaatgcccgggaatctcattcaccgggcattgtgtcgtttatgcgcagcgcgtgcgcttacttattaaaccgcagtctggaaaatcaccccgtccgctttttcggtgtactgagaaagctggtcgaagttcagataacggtaagtatcaacggctgttttatctacctgcgccacgtaggtctggtactcttccggcgtcggcagtttgccaatcagcgccgcaacagcagccagttccgcagaagccaggaagacattcgcgccagtacccaaacggttcgggaagttacgggtagaggtggaaaccaccgtcgcaccgtctgctacacgcgcctggttacccatacacagggaacagccagggatctcgatacgagcaccactcttaccgaagacgctgtagtagccttcttcggtcagctgcgcagcgtccatacgcgttggcggtgccacccacaggcgggtcggcaactgacctttgtgcgcatccagcagtttaccagcagcacggaagtgaccgatgttagtcatgcaagaaccgataaatacttcgtcgatcttctcgccctgtaccgcagacagcggacgtgcgtcatccgggtcgttcggagcacagaggattggctctttgatatccgccagatcgatgtcgatcactgccgcgtattccgcatctgcatcggcttccagcagctcaggattcgccagccatttttccatgccctgaatacgacgctccagggtacgacgatcgccgtaaccttccgcgatcatccacttcagcaggacgatgttagagttcaggtattcaatgatcggttctttgttcagcttgatggtacaaccggcagcagaacgctcggcagacgcatcggtcagctcaaatgcctgctcaactttcagatccggcagaccttcaatttccagaatgcggccagagaagatgtttttcttacctttcttctcaacggtcagcagaccttgtttgattgcatacagcggaatggcatgtaccagatcgcgcagggtgatacccggctgcattttgcctttgaagcgtaccagaacggattccggcatatccagcggcattacgcctgttgcggctgcaaatgccaccagaccagaacccgccgggaaagagataccgatcgggaaacgggtatgggagtcaccaccggtaccgacggtatccggcagcagcatacggttcagccaggagtggattacgccgtcacccggacgcagcgacacaccgccacggttcataatgaagtccggcagcgtgtggtgcgtgttcacgtcaactggcttcggatacgccgcggtgtggcagaaagactgcatcaccaggtcagccgagaaacccaggcacgccaggtctttcagttcatcacgggtcatcgggccggtggtatcctgagaaccaacagaagtcattttcggttcacagtacgcgcccggacgaatgcctttcacgccacaggcacggcctaccattttctgcgccagcgagaagccgcgatcgctctcagcgacatctttcgcctgacggaacacatcgctgtgcggcaggccaagtgcttcacgcgctttggtggtcaggccacgcccgataatcagcggaatacggccgccagcacgcacttcatcaatcagcacatcggttttcagttcgaaggttgccagcagttcgccggtttcgtggttacgcacttcacctttgtacgggtaaacgtcaattacgtcgcccatgttcaggttagagacgtcgacttcgattggcagtgcacccgcgtcttccatcgtgttaaaaaagattggtgcaattttaccgccgaggcacaaaccaccgccgcgtttgttcggcacatgtggaatatcatcgcccataaaccacagaacggagttcgtggcggatttacgcgatgaacccgtacccacaacgtcaccgacgtacgccagcgggaaacctttctgttgcagagcttcaatctgtttgatcgggccaacaacaccaggctgatctggctcaataccttcacgggcgtttttcagcatcgccagcgcgtgcagtgggatatccgggcgtgaccacgcatctggtgccggagagaggtcatcggtgttggtttcgccagtgactttgaagacggtaacggtcagtttttcagccagcgccgggcgattcaggaaccattcggcatccgcccaggactgcattacctgcttcgcatattcgttgcctgctttggctttctcttctacgtcatagaagttatcgaacatcagcagcgtgtgagaaagtgctttggcagcgatcggtgccagtttggcatcatccagcgcgtcgatcagcggatgaatgttgtaaccaccctgcatagtgcccagcagttcaatggctttttccggagtcagcagcggggatttagcttcgcctttggcgacagcagccaggaagcctgctttgacataggcggcttcatcgacgccagggggaacacggttggttaacagatctaacaggaattcttcttcgcccgcgggcgggtttttcagcagctctacaagtgcggccatttggtttgcatccaggggtttgggcgcaatcccctcagcggcacgctcagctacgtgcttacggtattcttctagcacgacggttctcctcgctctcattgtcatagtgcggcaggcgattctcttcacgctcctgtgagacagcagtttgtagggtaaatgcccagtaccgcaacgggcagaatagcaggattttgacgatgtgttaatctgtttacaaaaaagcaacataaaaagtggctgaatcgttaaggatagtctagagaatgtttccctccgtaaaaacttcgttaattcgcatggtgataatcacctttctcaacgaatcccaagattagtcaaaatttaaactacggcctctttatactcggattcacagcacctgcgggtggcagttcgccgaccattgcgatttccttgagatccgaattatgaaaatgactttgccgtttaaaccccatgtgctggcgctaatttgcagtgccgggctttgtgccgcctctgccgggctatatataaaaagccgcacagtggaagcgcctgtggaagcgcaatcgacacaacagactgcgcctgacatctccgcagttacgcttcctgcaacggtttccgtgcctcctgtaacacctgccgtcgtcaaatctacattcagcactgcacaaatcgatcaatgggtcgcgcccgtcgcgctgtaccccgactctctgctttcacaagtgttaatggcatcaacctatccggcaaacgttgctcaagcagtgcaatggtcacacgataatccacttaaacaaggcgatgctgctattcaggcggtatctggccagtcctgggacgccagcgtcaaatcactggtggcctttccacagttgatggcgttgatgggcgaaaacccgcaatgggtgcaaaacctgggcgatgcttttctggcgcagccgcaggacgtgatggactcggtacagcgattgcggcaactggcgcaacaaaccggctcgctgaagtcatcaactgaacaaaagatcatcacgacaacgaaaaaagtcgtaccggtaaatcagcccgccaacgcccctgccacacaatcaaataccgtttctacgtccagccccgtcgtcgcagaacctgcaccgaccgtaataaccattgagccagccaatccggatgtggtttatattccgaactacaacccaaacgtggtttacggcagttgggccaataccgcttatccgccagtttatctgccgccgccagccggagaaccgtttgttgacagctttgtgcgcggattcggctatagcatgggcgttgctaccacatacgcactattcagcagcatcgactgggacgacgacgatcatgaccatcatcatcatgacgatgatgattatcatcaccacgatggcggtcatcgtgacggtaatgactggcaacacaacggcgacaacatcaatatcgacgtcaacaatttcaaccgtatcaccggtgagcatcttactgataagaatatggcatggcggcacaatccaaactaccgtaatggtgtgacctatcatgatcaggatatggcaaagcggtttcatcaaaccgatgtcaacggcggaatgagcgccacgcagttacctgctccaacacgcgacagccagcgtcaggcggcagcaagtcagtttcagcaacgaacacacaccgcccccgtcattacgcgagatacccaacgtcaggcagcggcacagcggtttaatgaagctgaacacaatgggagctatgacgacttccgcgacttcagccgtcgccagccactgacccagcaacaaaaggacgccgctcgtcagcgttatcagtcggcttctcctgagcagcgccaggcggctcgcgagaaaatgcagactaacccacagaaccagcagcgaagagaggcggcacgtcagcgtattcagtccgcgtcgcctgagcagcgccaggcggttcgcgagaaaatgcagactaacccgcagaatcaacagcaaagagatgcagcacgtcagcgtatccagtctgcctcgcctgagcagcgtcaggtttttcgagagaaagttcaggagagccgcccgcagcgtctaaacgacagtaaccatactgcccgattgaataatgagcaacggtcagcggtacgcgaacggttgtctgagcgtggagcaaggagactggaaaggtaaattgcaggcgtaaaaaagcggcgttgttagccgcttaagactgatgacaaacatcgaatcgcccgatgcgcaagcttatcgggcctacacaagccatgcaatatattgaatttgcatgattttgtaggtcggataaggcgtttacgccgcatccggcatcaaccacgagcactttatcaacaatctgaagcggccagaatagccgcttcttaatttgccggatgttccggcaaacgaaaaattacttcttcttcgctttcgggttcggcaggtcggtaatgctaccttcgaacacttctgccgccaggcccacagactcgtgcagagtcgggtgcgcatggatggtcagtgcgatgtcttcagcgtcacaacccatttcgattgccaggccgatttcacccagcagctcaccgccgttagtaccgacaattgcaccaccgatcacacggtgagattctttgtcgaaaatcagcttggtcataccgtctgcgcagtcggaagcgatagcacgaccagaagcagcccacgggaaggtggcggtttcatagctgatgcctttctctttcgcttctttctcagtcagacctacccatgcaacttctggttcggtataggcgatggacgggataactttcggatcgaagtagtgcttcttaccggcgataacttcagcggcaacgtgaccttcgtgaacacctttgtgtgccagcattggctgaccgacgatatcaccgatagcaaagatgtgcggtacgttggtacgcagctgtttgtcaacgcggatgaaaccacggtcgtcaacttccacgccagctttgcctgcgtcgaggtttttaccgttcggcacacgaccaatcgctaccagcacggcgtcgtaacgctgcggttcagcgggtgcttttttgccttccatcgtcacataaatgccgtcttctttcgcttcaacggcggtaactttggtttccagcatcaggttgaatttcttgctgatacgcttggtaaagactttaacgatgtctttatcagctgccgggatgacctggtcgaacatttcaaccacgtcaatctgtgaacccagcgcgtggtatacggtgcccatttccagaccgatgataccgccacccattaccagcaggcgttctggaacttctttcagttccagcgcgtcagtggagtcccagatacgcggatcttcatgcggaataaacggcagttgaatcgggcgagaacccgctgcaatgatcgcgttgtcgaagttgatcacggttttaccgttctcaccttcaacttccagggtgttagccccggtaaatttacccagaccgttgaccactttgactttgcggcctttcgccataccagccagaccaccggtcagctgattgattactttctctttccaggtacgaatcttgtcgatatcggttttcggttcgccgaagacgataccgtgttcagccagcgctttggcttcttcgataacttttgctacgtgcagcagtgctttagaagggatacagccgacgttcaggcaaacaccgccaagagtgttgtaacgttctacgattacggtttccagacctaaatcagcgcaacggaaggcagcggagtaacctgcggggcctgccccaagtaccacgacctgagttttgatttcagtactcatcatgacctctatatatttatctccggcgggtctgacgttttttttatgacgcccattatccaccgggtcgttctatccgtcggtattttacaaaattgttaacaatttttaaacaacaaacggcaaccgatttgtctattcgctaataatctcaatacattcatgagattaccagaaaaaagccggccgttgggccggctcttttacttacatcaccagacggcgaatgtcagacagcgtgttgttaatgatggtaatgaaacgggcaccatcagcaccgtcgatcacgcggtggtcgaaggagagagaaatcggcagcatcagacgcggcacgaactctttaccattccacaccggctccatcgcggacttggaaacgccgaggatagccacttccggcgcgttcacaatcggcgcgaagtgggtagtccccaggccgccgatgctggagatggtgaagcaaccgccctgcatttcgcccgcagtcagcttaccgtcacgcgctttcttagaaatagtcatcagctcgcgagacagctcgatgatgcctttcttgttgacgtctttgaataccggaacaaccagaccgttcggggtatccaccgccacaccgatgttgatgtatttcttcagggtcagacgctgaccgtcttccgacaacgaactgttgaagcgaggcatctgctcaagagctgcagcaacggctttcatgatgaagacaactggggttatcttcacatccagcttacgtttcgccgcttcttcgttctgctgtttacggaacgcttccagctcggtgatatcggttttgtcgaagtgggtaacatgcgggatcatcacccagttacggctcaggttcgcaccagagattttctggatacggcccagttccacttcttcgatttcaccaaacttgctgaagtccactttcggccacggcagcatgcctgggataccgccgccagtcgccgccggagctgcttctgcacgtttgatagcttctttcacgtaagcctgaacgtcttcgcgcaggatacgacctttacggccagtgcccttcactttcgccaggttaacgccaaattcgcgtgccagacggcggatcagcggagtcgcgtgaacgtaagcgtcgttttcagcaaattcagatttgccttcggcttttgcagccggagctgctgccggggcttcagcttttgctgccggagccggcgctgccgcttcctgtttcgcaggagctgccgcaggcgctgcgccttcaacttcgaagatcataatcagcgaaccagttttcactttatcgccaacgttgactttcagttccttcacgacgcctgcaaacggagccggaacttccatagaagctttatcgccttctacggtgatcagtgactgttcagcggcaactttgtcgcccactttcaccatcacttcggtcacttcaacttcgtcaccgccgatatccggaacgttaacttctttcacgccagctgctggtgcaggggccgctgccggagccgcctcctgtttagccgccggagctgccgcgcctgcttcacccgcgacttcgaagatcataatcagcgagccggtagacactttgtcacccacgttcactttgatctctttcacggtgcctgcaaacggagcaggaacttccatagaagccttgtcgccttctacggtgatcagcgactgttcagcttcaactttatcgccaactttcaccaggatttcggtcacttcaacttcgtcgctgccgatatccggaacgttaacgtcttttgctgccgcagccgctggtgctgctgccggagctgcttctttcttctcttctgcctgagcaggtgcagcgtctgctgcaccgtcggcggaatcgaaaatcataatcagtgcgccggtctgggttttatcgccaacagagactttgatctctttaacgatacccgcctgcggagatggtacttccatagaggctttgtcgccttctacggtgatcagcgactgttcggcttcaactttgtcgcccactttgaccaggatctcggtgatttcaacttcatcagccccgatgtccggtactttgatttcgatagccattattcttttacctcttacgccagacgcgggttaactttatctgcatcgatgttgaatttggcgattgcgtcagcaaccactttcttatcgatttcgccacgtttagccagttcgcccagcgccgcaaccacgacataagaagcatcaacttcaaagtggtgacgcaggttctcacggctgtcggaacgaccgaagccatcagtacccagtacgcggtagtcgtcagccggtacgtaagtacggacctgctcagcgaacagtttcatatagtcggtagatgccactgccggagcgtcgttcatcacctgagcgatatacggaacgcgcggagtttccagcgggtgcagcatgttccagcgttcacaatcctgaccatcacgcgccagttcggtgaaggaagtcacgctataaacgtcagaacctacgccgtaatctttcgccaggatctctgccgcttcacggacgtgacgcaggatagaaccggagcccagcagctgaactttacctttgctaccttcaagggtttcgagtttgtagatacctttacggataccttcctcagcaccttccggcattgccggcatatggtagttttcgttcagcgtagtgatgtagtagtaaacgttctcttgtttttcaccgtacatacgctccagaccgtcatgcatgatgacagcaacttcgtaagcgtaagccggatcgtaagagatacagttcgggatagtcagcgactgaatgtggctgtgaccatcttcgtgctgcagaccttcgccgttcagggtggtacgaccggaagtaccgccgatcaggaagccacgcgcttgctggtcgccagccgcccagcacagatcgccgatacgctggaaaccgaacatcgagtaatagatgtagaacgggatcatcggcagattgttggtgctgtaagaggtcgccgctgccagccaggaacaacctgcgcccagctcgttgatcccttcctgcagaatctgacctttctcgtcttctttatagtaagcaacctgctcgcggtcctgcggggtgtactgctgaccgttcgggctgtaaataccaatctgacggaacagaccttccataccgaaagtacgcgcttcgtcggcgatgatcggtaccagacgatctttgatcgacttgttcttcagcatcacgttcagagcacgaacgaaagcgatagtggtagagatctctttgctctgctcttccagcagcgcgccgaaatcttgcaggctcggcagctccagcttctcggtgaagttcggctggcggcttggcagataaccgtgcagtttctgacgttgagcgtgcagataggtatgctcttcagaaccttccgggaaggtgatgtacggcagtttttcgatatctgcatcagacaccggcacattgaaacggtcgcggatgtgacgcacgccgtccatgttcattttcttaacctggtgcgcgatgtttttaccttcagccgcgtcgcccatgccgtaacctttaatggtatgagcaaggattaccgtcgctttgcctttggtttcctgcgctttcttgaatgcagcgtagattttcttcggatcgtgaccgccacggttcagcgcccagatctgctcgtcagtccagtctgcaaccagagctgcggtttcaggatatttaccgaagaagtgttcacgaacgtacgcaccatctttcgatttgaaggtctggtagtcgccgtcaacggtttcgttcatcagctggatcagtttaccgctggtatctttacgcagcagttcatcccaacggctaccccacatcactttaatcacgttccagccagcaccttcgaagatgccttccagttcgttgatgatcttgccgttaccggtgaccgggccgtcaagacgctgcaggttacagttgataacgaagaccagattatccagtttttcacgggtagcgatggtgatcgcacctttggattccggttcgtccatttcaccgtcgccgaggaacgcgtaaacggtttgtttagaggtatctttcaggccacggtgttccagatatttcaggaatttagcctggtaaatagcaccaatcggacccagccccatagatacggtcgggaactgccagaattccggcatcagtttcgggtgcggataggaagagaggccattgccgtgaacttcctgacggaagttatccagctgctcctgagtcagacgaccttccaggaaagcacgagcgtacacgcccggggagatgtggccctggaagtaaaccaggtcgccgccatcctgctcgttgcgtgcacggaagaagtggttaaagcacacatcataaatggttgcggaagactggaaggacgccatgtggccgcccagttcgaggtcttttttcgacgcacgcagaaccgtcatgatggcgttccagcggatagctgaacgaatacggcgttccagttccagattacccggatactccggttgttcttcaacggggatggtgttgatgtagttgctgataccggtgcctgcggctacgttgacaccgcctttgcgggcttcagcaagcagttggtcgatcagatactgagcacgctcaacaccttcttcacggatgaccgattcgatcgcctggagccagtcgcgagtttcgatcggatccacgtcatttgggaaacgttctgacatgggttattccttatctatctaataacgttgagttttctggaacctgtcccattgaactctcgccggaaagctcaataagacaggttctacgtttagttgccgcgcttttatatgcgcttgatttacaacatcttctggataatttttaccagaaaaatcactaattctttcgttgctccagacgacgcagagaacgctcacggcggctctcttcacggcttctgtcgagcaaaatttcttcgataaaggccagatggcgatgcgatgcttcgcgcgcttcttccggcttaccggccataatcgcttcaaatatgcgggtgcggtgactactcaccagcggcagcatctcgcgacgcgaatagagcaattcgaagttctggcggacattctgggccaacatcggctccatacaccttagcagatgaagcagaaccacattgtgggccgcttcggtgacggcaatctgatactggagtacggcgtttgattccgcgtccagatcgccagactgctgcgccagctctatggcatggtggagttcacggatgcgttccttgtcttcatcggtactacgcagcgcggcgtaataagcggcgataccttccagggcgtgtcgtgtttcgagcaagtcatactgtgattcaggatggtcggagagcagctccaccagcggatcgctgaagctttgccataggctgctctggacaaaagtgccgccaccctggcgacgaagcaacaagcccttcgcttcgagacgttgaatcgcctcacgcaaggagggacgggagacgtcgaactgttttgccagttcacgttccggtgggagtttttcgcccgggcggagagtgccttcgaggatcaaaaactccagttgctgctcaatcacatcggagagttttggttggcggattttgctgtaggccatgagttcctgtcttaagccacttgccgaagtcaattggtcttaccaatttcatgtctgtgacgctaaagtaacaaagtattcaccttatgtccatacaggttttgattgaaatcatgaaactgtgcacattttaacaacttgacatatataacgtttcaaagttgtaactatgcacaaatgttaaatttacccaccaaggggtgaccttaacagaattgaaacgaaaaaatatttcctctgaaccgattcaccaagcaacaaaacgcataacaattcaattatgtgaattaatatgtaaaatgaatgttcagggaaggagagaaaggtagtatttacctatgttttctttttacattgcttattatcactgcaatcgccaccgtaaccttctcgtagcgaaaatcatcacttaaccagaacgtgatgattttcaggtgacagattctgtttagagttcattctgaatctttgaacaaaggcaatccttgcgaacgccgccattctttgacgattttcaggatgttttcaggtttaccatcttctggggaattaggatagaaaatgagatctccctttttaggatgttcagtaattttaatgaaatgatccactaaggtatcgagatatttttctaattttttcccttttagggatttatctttgctagttgcatttactatctcctcaagcatttcaagaaattcaccttctgtgtaaaaatatattttatattttaaatcatgcatatacattatctcctgtagtgaatttcatcatgtagtcgaggcgtaacaatcctttaattatcaatatcataaatttcgccaccacattcaatcgcaacactatgatatatatggaattctttaacaatttccttagagccataatgccaaccttcaagaggcgcttttgcgattaatccttgttttatacgtgtttggttaccagttgaaaactgcgctatcaactccggatactgactcacctccagccaaagggtatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaaactgcgctatcaactccggatactgactcacctccagccaaagggtatcggtgaaagcgggaaattgataaaataacctaatgaaatttcagtattttacctgttttttaagagcacccacattattattttatgttattaacatcatcgcattagccagacgcgatgatgttccatatatagttttattatctactttatttagagtctttaaacaagggtagcccctgtgaacgccgccattctttgacaattttcaggatgttttcaggttcatcatctcccttctttgcaggatagtagataagatcgctcatcaacggatgttgtgtaattctggtaagatgttcttctagatcatcccaatatttgtcaagctcttccccttttaattgagcgttatccccggttggatttgtaaactcgccaagcaactcaatgaattcccgctctgtgtaatcttctattttatctttaaaattatacatttaactatctcctgtaataaatttcatcatgcaaatgaggtgtgccctccttaaattatcaatatcgtaaattccgccactatattcaatcgcaacacgatgatacatgtggaattttttaacgatttctttagtgccataatgccaaccttcaagtggtgcttttgcgattaatccttgttttatacgtgtttgattaccgcttgaaaactgcgctatcaactccggatactgactcacctccagccaaagggtatcggtaaaagcgggaaaatgataaaataacccaatgaggcttcagtatttttacctgttttttaagagcaatcacattattattttatgtcatttatatcatcgcattagccagatgcgatgatgttccatatatagttttattatctactttatttagagtctttaaacaagggtaacccctgtgaacgccgccattctttgacaattttcaggatgttttcaggcttatcatctccttgacttttagggtagaaaatgagatcgctccctgacggatgctgtgtaatttcaataaaatgatctactaatgaatcccagtacatttctagctccttaccttttaagggctttccatctttcatagttgatctcaatccgcctaaaaaattaagaaattcctcctcggtataatcttcgagcttttctttaaacatatttatctcctgtagtgaatctcatcgtgtagtctgggggtaacaattcgtaagttatcaatatcgtatacgctgccgccatattcaattgcaacacgatgatgtatctggaattttttaactatatctttagggccataatgccaaccgtcaataggtgcttttgcggtcaatccttgttttatacgtgtttggttaccacttgaaaactgcgctatcaactccggatcctgactcacctccagccacagcgcctcgcgaaactcatcaaaggttttaaactcccgtccgcgcaatttatcagcaatatgcgccgggattggtgcgccgttgccgttattggataccgacatatccagccagcgagttcctggtgaaagcgggacgccgtgccctgttacaacaccaggcagctttcgcggatcctccttcaggtaaacatagataggcttaataccggatcccgccggaaaaaccagaatataatcgttgaattctttcggatcaggaaccgggaatggcggcgtggtataggtatctgtaccgtccggaatcggcgtcaccagaatggtgggctgatccagcggcggcctgtcgttaccggtatggcccggaacattcccatgttccggattttccggcgtccaggtaatcagggggccatcgacatcgtgagcgggggtaaattcataacgctgcgtctgctcgttccactgcatgttcgccacgcggacgttttcatacggcgtaccttcacccgtatgaacaccatatacctggggcttgctgtgaatgtcagttccccagaaaaaacgcacccgggtagtggcggtactgcctgcaagcgctttctggcgcagttcttcctcataccagaactcatcacgtccaggcacacgagcactgccctcacccgcagagggaatatacagagcagatgccaacgcaccgatgtaagagccgcgggttgcactgagtacgccactgagcgaccattttccccatatttgagtcgccaacacactacccggaaacagtagcatggtttgagcttctgcgggttccccgataacgttagcctcgggatggtggtatccacagcagtcatcaaccactggctgagcgaaaatcgctacttgaccgaagttttcagcgggttcttctgccgttccggcatctgtacatcccttctccttcagacaggatttggcatagaccggtttaaccgctggtggagagagtggaaggttaacaactggtagcggctcagggttaagattactggcaggtgggtttttaggtggaataaataagctattatagccagcagaaaaggccaaccagtcaaattccgtattggctattagatgtttgcataatatgtagtcataattaacatttacacattcggtaggaagattattgtcagaaatgtttacatgaatagcagttaatgaagcatttcttagctgaatataataataccgttcccagcgcccgcttttatttatacgatacaaatcgatttcaataaataaccgctcattctgattgatggcattagacagtagcggtgagcttttatcaatgagtttgcaaaattgtagcccctgtagattaacgcctttaccagtactggtaatggcgttggtgagtgcaaaggcaaaaatttcatcttcatggccaacctgccagcgattaccaaccgacgcatacgtcccacagcctgaagaaatatcgccctgcttctcaccgattattctcaggtaaacaatatcgcccactttatttcattcccgtttatccttaacttttttgcattaaatagaaaacttatttctcgatcaataagaaactcttttaatgaaaaattatttcaattacttaacgttttcacttagctcgcaatattatatttaaatactcgcgttacaaccccattgtattattaacatctatttattcttatatgaccttttgtaagattattgtgctggtggctaaggcatggtgttcagcaggcagacaaatccgacatatagctagttaaaacagtatgttatcagacttaaagtatctattaaatgtgatgaaaaacttacaattgctttttttttatccagaaaatcaacacatctacataaagcaggtgcattctcgcgcatataccattatcttgtgatagttaaaagtactatcatcataattcagttacataaaatgtaaagaaaccaatacaacaaacggaattacaaaattacacacgcattgctgcgtagttcaaaaaaacaacacaacacgaggtttcataatggaaggtcaacagcacggcgagcagctaaagcgcggccttaaaaaccgccatattcagcttatcgcgctgggtggcgcgatagggacagggctattcctgggtagcgcctccgtaatacagtccgcagggccagggattatcctgggttacgccattgctggttttatcgcctttctgatcatgcgtcagctaggtgaaatggtggtcgaagaacctgtcgcaggctcctttagccactttgcttataaatactggggcagttttgccggtttcgcctctggctggaactactgggtactgtacgttttagttgccatggcagagctgactgccgtgggtaaatacattcagttctggtatccggaaatcccaacctgggtttctgccgccgtgttctttgtggtgatcaacgccatcaacctgacaaacgtaaaagtgtttggcgagatggagttctggtttgccattatcaaagttatcgcggtggtagcgatgatcatcttcggcgcctggctgctattcagcggcaacggcggcccgcaggcgagcgttagcaacctgtgggatcagggtggtttcctgccacacggcttcaccggtctggtgatgatgatggcgattatcatgttctctttcggtggtctggaactggtggggatcaccgcagcagaagctgataacccggagcaaagtatcccgaaagcaactaaccaggttatctaccgcatcctgattttctatattggctcgttagccgttctgctctcactaatgccgtggacccgcgttaccgccgataccagtccgtttgtgctgatcttccacgagttaggcgatacctttgtagcgaatgcgctgaatatcgtggtactgactgctgcgctctccgtgtacaacagctgcgtatattgcaacagccgtatgctgttcggtctggcacaacaagggaacgcgccaaaagcgctggcgtctgtcgataaacgcggcgtaccggttaacactattctggtgtctgcgctggttacggcattgtgcgtactgattaactaccttgccccagagtccgctttcggactgttaatggcgctggtggtatctgcactggtcatcaactgggcgatgatcagtctggcgcatatgaaattccgtcgagccaaacaagaacaaggcgtggtaactcgcttccctgccctgctttatccgctgggtaactgggtctgcctgctgtttatggcggcggtactggtgattatgctgatgaccccaggaatggcgatttcggtatacctgatcccggtatggctgatcgtgttaggtatcggctatctgtttaaagagaaaaccgccaaagccgtaaaagcgcattaatctctctacgccctcacccgtgcagggtgagggcaataatctttacaccaacgccccgtaaatcgtcagtagcgcaattaccaccacgaccacgaacgaggttttcttcgccattgaaaccgctgcctttggcgtctccaccttatcgacatgcggttcacgcgccagagagaactgtgccagacgcgttaatacctgatattgcgaagtatggaaatcacccagcgaagcaaaccaggccggtaacgctttctcaccatgaccgatcaaggcatataccacacccgcaagacgaaccggcacccaatccagtacatgaagcacgccatcaatgccggactgtaaacgatgatgcggcgtctggtatcgcgccagccagtattgccatgcacgcaaaaacgcataccccatcagcgtaacgggtccccaggttccccccacaatcagccagaacagcggagcaagataaaaacgaaagttaatccacagcaatgcattttgcagctcacgcaaatactcacgttcatcgcagcctgccgggacgccgtgaatcatggtgagttcgccagccatcgtggcacgggcatggctatcattacgtgaagcagctgtcagataagcatgataatgaagacgaactttacctgcgccaatacacagcaaaccaatcagcagccacaccagcagcgtgggaacgttgaacaatactccctgcaatgcgcgtaacagtaaaaaagtcacgcccatcgcaataatggtcatgcataacgtgcgcccgagagaaaaatgtttcacccgccgaaagaacgcttcaagacgatgatcaagctgccagtgctcgcccaacttaaacaggcgctcgaaaattaacaccagtaaggttgtaaatagcgtcatgttgtctccttgctgaccagcgcacgaaaccgtgcccaatcaaatgcagggccgggatcggttttccgatccggcgcaatatcacaatggcccgtcatgttattagcgatatccggatagcgatcaatcagtgcccgcgtaaccgccgcaagctgttgatactgcgcatcggtatacgccagcgtatcggtgccttccagctcaatcccaatagaaaaatcattgcagcgttcacgcccctgatactgagagactcccgcatgccaggcacgtttatcgaaaggaacatactggactatttcaccatcgcggcgaatcaaacagtgagcggagacgcgcaaatgggcgatctcagcaaagaaaggatgcgcctgcggatcaatagttccagtgaataatgcgtcgatccacggaccgccaaactcgcctggcggcaggctaatattgtgcaccaccagcagagtgggtgtttcgtcatccgggcggcaatcgtaatgtggtgagggaacgcggcgcgcgccagccagccacccctgttctaacaacatgcaggatctccttatatgtggtgctaatacccggttcagagtagcatgtttctaccttatgattcgttagctatctggagttttaacatgccgcctcgccgctataaccctgacacccgacgtgacgagctgctggaacgcattaatctcgatatccccggcgcggtggcccaggcgctgcgggaagatttaggcggaacagtcgatgccaacaatgacattacggcaaaacttttaccggaaaactctcgctctcatgccacagtgatcacccgcgagaatggcgtattttgcggcaaacgctgggttgaagaggtgtttattcaactggcaggcgacgatgtcaccataatctggcatgtggatgacggcgatgtcatcaacgccaatcaacccttgttcgaactcgaaggcccatcccgcgtgctgttaaccggcgaacgcactgcgcttaattttgtgcaaaccctttcaggagttgccagtaaggtacgccactatgttgaattgctggaaggcaccgacactcagttgctggatacgcgcaaaaccttacccggccagcgttcagctctgaaatacgcggtactttgcggcggcggagcgaatcaccgtctggggctttctgatgccttcctgatcaaagaaaaccatattattgcctccggctcagtgcgccaggcggtcgaaaaagcgtcctggttgcacccggatgcgccagtagaagtcgaagtagagaatctggaagaacttgatgaagccctgaaagcaggtgccgatatcatcatgctggataacttcgaaacagaacagatgcgcgaagccgtcaaacgcaccaacggcaaggcgctactggaagtgtctggcaacgtcactgacaaaacactgcgcgaatttgccgaaacgggcgtggactttatctccgttggtgcgctaactaaacacgtacaggcactcgacctttcaatgcgttttcgctaattgctaacagatttatccgctccatcgcgggcggataaatctccccttccccaactttcttcgtaacgcctcgcaaatttcttgtctttcgctgcaacgaaataaaaaacctcggaagctgctttcccgtttcgttttttgcccctcgcttgtgctgatggcgtttgccaaagtagcgccaaccaaatcaaggagcgaaacagatggacaagcaacgcggttttacacttatcgaactgatggtggttattggcatcattgccattttaagcgccattggtattcccgcttatcaaaactacctgcgcaaagccgcactcaccgacatgctacaaacctttgtgccttaccgtaccgccgtagagttgtgcgcgctggaacatggtggattaaatacctgcgacggtggcagcaatggcattccctcgcctaccaccacccgctatgtttcagccatgagtgtggcaaagggcgtggtgtcgctgaccgggcaagaaagtctcaatggactaagcgtcgtcatgacgccgggttgggataacgcaaacggcgtcaccggctggacgcgtaactgcaatattcaaagtgacagcgcattgcagcaagcctgcgaagatgtcttccgctttgatgacgccaactaaggagcggcaatgaatattccacagctcactgccctgtgtctgcgttatcagggagtcttgctggatgccagcgaagaggtggttcatgttgcggtagtcgatgcaccttcgcatgagctactggacgcattgcatttcgctaccaccaaacgtattgagatcacctgctggacacgccaacaaatggaaggtcacgccagtcgcacacaacagacattgcccgtagctgttcaggagaagcatcagcccaaagcagagttgctgactcgaacgttacaatctgcgctagaacaacgcgcgtctgatattcatatcgaaccagcggacaatgcctaccgcatccgcttgcgtatcgacggcgtattgcatcctttaccggacgtttcaccggatgccggagtcgcattaaccgccagattaaaagtgctgggaaacctggatattgcggaacatcgcctgccgcaggacgggcaattcactgtcgaactggcaggaaacgccgtctcatttcgtattgcgaccttagcatgtcggggtggtgaaaaggtggtattaaggttgttacagcaggtgaaccaggcactggatgttaacacgcttggaatgcagccgtcacaactggtggactttgctcatgccttgcaacaaccacagggactggtgctggtaactggccctacaggcagcggcaaaacggtcacgctttatagtgccctgcaaacgctgaataccgctgacattaatatttgtagcgtcgaagatccggttgagatccccatagccggattaaaccagacgcaaatccattcgcgtgccggactcacctttcagggcgttttgcgtgcgttattgcgccaggatcctgacgtcatcatgatcggagagatccgcgatggcgaaacggcagaaattgccattaaagccgcgcaaaccggtcacctggtgttgtctaccctacacactaactccacctgcgaaacgctggtacgtttacagcaaatgggagtcgcccgctggatgctatcatcggcgcttacgctggtaatagcccagcgtctggtacgcaaactttgcccgcattgtcgccggcagcaaggggagcccatccatattccagacaatgtatggccatcgccgctgccccactggcaggcacccggttgtgtacattgctaccacggtttttatggtcgcacggccttatttgaagttctgcccataacaccggtcatacgtcagcttatttccgctaataccgacgttgaatcgctggaaacgcacgcccgacaggcgggtatgcgaacgctttttgaaaacggctgcctggccgtggagcaaggcttaaccacctttgaagagttaatccgcgtattggggatgccgcatggcgagtaagcaactctggcgctggcgtggcataaccggcgacggcaatgcgcaagatgggatgctatgggcagagagccgtgctttgctgctcatggcactacagcaacagatggttaccccactaagcctgaagcgaatcgccatcaattctgcgcagtggcgaggagataaaagcgcggaagtcattcatcaactggcgacgctactcaaagccgggttaacgctttctgaagggctggctctgctggcggaacagcatcccagtaagcagtggcaagcgttgctgcaatcactggcgcacgatcttgaacagggcgttgccttttccaatgccttattaccctggtcagaggtatttccgccgctctatcaggcgatgatccgcacgggtgaactgaccggtaagctggatgaatgctgctttgaactggcgcgtcagcaaaaagcccagcgtcagttgaccgacaaagtgaaatcagcgttacgttatcccattatcattttagcgatggcaatcatggtggttgtggcaatgctgcattttgtactgccggagtttgccgctatctataagacctttaacactccgctaccggcgctaacgcaggggatcatgacgctggcaagttttagtggcgaatggggttggttgctggtgctattcggctttctgctggcgatagccaataagctgctgatgcgccacccaaccaggcttatcgcacggcagaaattgctgttacgcatcccgattatgggttcactgatgcggggacaaaaactcacgcagatctttacgattctgacgctgacacaaagtgcaggcatttcttttttacagggcgttgagagcgtcagagaaacaatgcgctgcccgtactgggtgcaacttctgacacaaatccagcacgatatcagtaacggtcaccccatctggctggcgctaaaaaatgccggtgagtttagcccgctctgtttgcaattagtgagaacaggagaggcatccggctcgctggatctcatgttagacaacctcgcccatcatcatcgggataacacaatggcgctggcggataacctcgcagccttactggaaccggcgttgctgatcataacgggaggaattatcggtacgctggtggtggcaatgtatctgccaattttccatttaggcgatgcgatgagtggaatgggataacgctggcgtgttgctccacgccagcgttggtatattacaggttgttgaagatgcggttttcttgttcctgcacacggataaacgtggtgcgcttggtcagttctttcaggcgtgaagccccaacgtatgtacaagctgaacgcaggccgcccaaaatatcacgcgcggtattttcaaccgggcctcgcagcggcagcttaacggttttaccttctgctgcgcgatattccgcaacgccgccaacgtgacgtttcatcgcagactctgagctcatgccgtagaacagcataaatttctcgccgttctcctcaacgatgcgaccgccgctctcttcgtggcccgccagcatgccgccaagcattacgaaatcggcaccgccgccaaaggctttcgcgacatcgcccggcgtggtgcagccgccatcgctgacgatcattccgcccagaccgtgcgcagcatcggcgcattcgatcaccgcagaaagttgcggataaccgacgcctgttttgacgcgagttgtacaaacagaacctgggccaatgccaactttaacgatatcggcaccggagaggataagctcctcacacatttcaccagtcactacgttgcctgcacaaatggttttggtcggccacgcttcacgcgctttcgcaacgaactgcacgaagtgttcggaataaccattcgccacgtcaatacaaacgaaatttaatgccgggttcaggtcgagaatctgtttagttttttcgaaatccgcatcagacgtgccggtagaaaccatcacatgtttcagcacatcagcggaagaattgttgataaacgcttgccactcttcgacagaatagtgtttatgcacagcagtcagaatatcaaaagaagccagcgcagaggccatagaaaatgtgcctacggtgtccatattggcggcgataatcggcacgccggaccagctctgacctgaatgtttgaaggtgaattgacgttccagttcaacatcggaacggcttttaagagtggagcgtttagggcggatgagaacgtctttaaaacctaacttcagatcttcttcaatacgcatgtgcggattcctggggttaatggctataagggtaagagcgcaactccagtgacgttatcatacgcactaatcaatgcggcgcaagactgcgaaattgtctttttttacgctacaatcccataaatttacctggtaaatagtgagcgaacgtttcatcaatttcgctttcgtgcactcatttttaacgttttgataatcatgatgaattcccgggaatataaattatgaggtatatagttgccttaacgggaggcattggcagtggcaagagtaccgttgccaatgcgtttgctgatctcggaattaacgtcattgatgccgatattattgcgcgtcaggtggttgaaccaggtgcacctgcgctacatgccattgctgatcactttggcgctaacatgattgctgctgatggaacattgcagcgccgggccttgcgcgagcggatcttcgccaacccggaagagaaaaactggcttaacgccctgctgcatccgctgattcagcaagagacgcaacaccagatccagcaagctacttccccctatgtactatgggttgtgccattgctggtagaaaactcactgtataaaaaagcgaatcgagtgctggtggtggatgtcagcccagaaacgcaacttaagcgcaccatgcagcgcgacgatgtaactcgcgagcatgtcgaacaaatccttgctgctcaggcaacgcgcgaagctcgccttgccgtggcagatgacgtcattgataataacggcgcaccggatgctatcgcatcggatgttgcccgcctgcacgcatactatttgcagcttgcgtcgcagtttgtctcacaggaaaaaccgtaatgcagacccaggtcctttttgaacatccactaaatgaaaaaatgcgtacatggctgcgcattgagtttttgattcagcaactcaccgttaatctacccatcgttgaccacgctggcgcgctgcatttcttccgtaatgtcagtgaattactggatgttttcgagcgcggcgaagtccgcactgagctgttgaaagaacttgaccggcagcaacgtaaactccagacctggattggcgtgcccggcgtggaccagagccgtattgaagcattaattcagcagttaaaagcggcggggagcgtattaatctccgcgccgcgtatcgggcaatttctacgtgaagatcgtttgattgctctggtgcgtcagcgactgagcatcccgggcggctgttgcagctttgatttacctacattgcacatttggctgcatctacctcaggcgcagcgcgacagccaggtagaaacctggattgccagcctgaacccacttacccaggcacttaccatggtgctggatttaattcgccagtcggcccccttccgtaaacaaaccagcctgaatggtttttatcaggataacggtggcgatgccgacttgctgcgcctgaatctgtcgctcgattcacagctttatccgcaaatttccggtcataagagccgttttgccattcgttttatgccgctggacagtgaaaacggacaggtaccagaacgtctggatttcgaactggcctgttgctaaggagtaaaaatgtcagaaactattacggtgaattgcccaacctgcgggaaaacggtggtgtggggtgaaatcagcccgtttcggccattttgctccaaacgttgtcagctgattgacctcggagaatgggctgctgaagaaaaacgaatccccagcagtggcgatctttccgaaagcgatgactggagcgaagagccaaagcagtgacattctatctgatgcgatgctggcctgataaaacgcgccagcgtcgcatcaggcatcatatgcaaatgtcggatgcagcgtgacgccttatccggcatacacacgcttaagtttcgcaattaccggttcattggctggcggaaaatcatcggcattaagaccgaccagcgacatccactcaccgggttgcccttctttaccccacggctccccttcccagctttcgaccagccagaaccacagagttatatgcctgtccgggaattcatattccagtttttcaaatagcgaaaaatgttgtggggtaatcccgacttcttcctgaagttcacgcaccaccgcctgttccggcgtttcgcccatttcaactttaccgccgggaaactccagtttattcgccatgtgcgcatctgctgcgcgacgcgttataaagatttcattgttctcgttgcgaataatacctaccgcaatttgcagctttttcattgtcttaaacctataaaaaaggcgcagaatcctgcgccttttacttcaacagttagcttttattgcaggcggccatggcactgcttgtattttttaccagaaccacacgggcaaggatcgttacgtcctacttttcgttcaccggtttgcgccgccagtgcagctgcggctgcagagtcgtcatcctgatggctaagctgctgcatttgcgctaaacgctcggcttccatacgacgctgttgttccagctcctcaacctcttcaggcatacgtacctgaactttgctcagcgtgctgataacttcatattttaacgactccagcatcgctgcaaacatggagaacgattcacgtttgtattcctgcttcggatctttctgtgcatagccacgcaggtggataccctgacgcagatagtccatcgctgccaggtgctctttccacagggagtcaagcgtttgcagcatgacgcctttctcgaagtgacgcatcatctcagcaccaaccacttcttctttacgctgatacacttcgatggactgcgccagaatgcgctcacgcagcgtctcttcatgcagttctggttctttatccagccactcggcaattggtaaatcgaggtcgaaatcgttcttcagacgttcctgcagccccggaatatcccacatttcttccagcgactgtggcggaatgtaggcatcaatggtcgctttgaacacatcttcacgaatgctgttgatggtttcgctcacatcgctgacatccagcagttcgttacgctgggagtaaatggcgcgacgctgatcgttagccacgtcatcatattccagcagttgtttacgaatgtcgaagttacggctttcaactttacgctgggcgttggcaatcgctttagtcacccacgggtgttcaatggcttcgcctggcttcatacccagtttacgcatcatgccggatactcggtcggaagcaaaaatacgcatcaacgcatcttccatcgacaggtagaaacgggaagaaccagcatccccctgacgaccagaacgaccgcgcaactggttatcgatacgacgggattcgtgacgctcggtaccgatgatatgcaggccacctgctgccagtaccgcatcgtgacgtacctgccagtcggctttaattttttcaatttgctctgcagtcggattttccagcgcggcaacttctgcctgccagctaccaccgagcacaatatcggtaccacgacccgccatgttggtcgcgatagtcaccgcagccggataacctgcctgagcaacaatcgccgcttcgttggcatggaatttggcgttcaggacgttgtgcttaataccggctttggtcagttcatttgacaccagctccgatttttcgatggagattgtacccaccagcaccggctggcctttcgcagtacgttctttgatatcttcaatgatcgcctgaattttttccgcttcagtcatgtagaccaggtccggcagatctttacgaatcattggacggttggtcggaacaacgacagtatccagcttatagatggagctgaattcgaaagcttcggtatcagcagtaccagtcatccccgccagtttttcatacagacggaagtagttctggaaggtgatcgaagccagcgtttggttttcgttctggatctgcacaccttctttcgcttccacagcctggtgcagaccatcggaccagcgacggccctgcatggtacgaccggtgtgttcgtcaacgatgataacttcaccatctttaacgatgtagtcgacgtcacgggtaaacagcgcatgagcgcgcagcgccgccgttacgtggtgcatcagcatgatgttggccggagagtacagagactctccttcatccatgatgccttctttaaccagcagttcttcaatcaggaccagaccacgttcggtcaggttcacctggcgagatttttcatccaccgagaagtggccttcgccctggaaggtttcggagtcttctttttcctgacggatcaggtgcggaataattttattcacgcgtttatacatttccgagctgtcttctgctgggccggaaatgatcagcggtgtacgcgcttcatcgatgaggatggagtccacttcgtccaccagcgcatagtgcagtttacgttgtacacgttcttcagggctgaatgccatgttgtcgcgcaggtagtcaaagccgtattcgttgttcgtaccgtaagtgatgtcagcagcgtaggcttcacgctttgccggtgctggcatgcccggtaggttgataccgacagtcaggccaaggaattcaaacagcggacggttgttttcggcgtcacgttgcgccaggtagtcgttgacggtaactacgtgtacgcctttaccggttagtgcgttcaggtaagcaggcagcgttgcggtcagggttttaccttcaccggtacgcatttcggcgatgcagcgttcgttaagaaccataccgccgagtaactgaacgtcgaagtgacgcatgccaaagacgcgcttacttgcctcacgcaccacggcgaaagcttccgggatcagattttccagcacttcgcctttttccagacgcacacgaaactctgcggttttccctttcagttcttcgtcggagagtttttccatctccggttccatggcattgatgatgttgaccactttgcgcatccggcgcagggtgcgatcgttacgactaccgaaaactttagttaataatttgattagcataataaaatctcaaacgccccgcgttgcggagttaataaaatgaggtaaaggtttattgttgttagctgaggcgttgagggccagcacggatgccttgcgcctggcttatccagacgggcgtgctgaattttgcttgtggggtaaaatgcgcataatcaatgcgataacccttttcagacggcgtgccttcctgggtcagaagcgcgctaagcgtatccagtaatgcaagatgttgcgcctgaagaggcaaagattcttcagcaacgggcagcgtttgcggtgccatcgcgaaggaaagatggcggattaccgtgcgaatggcatgttgatgccagtaatcaacggaatagttcgaattcgggcggcgcgtgttcgcttccagcaaggccaattgaccaaagttaactttggctgaaggctcgtggttgcgggttgtcgcttttgcgggcgcgtttggttcggcggcattgctgagtgcaggcaaacctaaactcgccgcgaccatccctaataagagatgcggccagaagtagcgtttaccaaactgtcgccagcgcgtcagtattccactcacgttattgccatcccgatcgtattcaaacgtatttagcgcacaaatcttatcattaaagcctgaagtccacagcacgaatgaagataagttgtgcgtaaaagtgcttaagaaaacagcgttcgcaccgttttttatagctcttataaaattcaaaaaaaaacgactggttcacctggccggagagagtgccagatttgccagtcgaattttatacgacagtataaatgtcgttatgccagtacggctgaaggcgctttgaaggccaacggcagttctgcgtcgtcctggaaggtcacatattcccaggcttcctgtttcgccaggacagcctgcagcagtttgttattcagtgcatgaccggatttataagcggtaaatgcaccaataatattgtgaccacacatgaacaagtcaccgatcgcatcaagcattttgtgacgcacaaattcgtcttcaaaacgcaggccgtcttcgttcagtacgcgataatcgtcaacaacgatggcacaatcgaagctgccgcccaggcacaaaccacgggactgcagatattcgatatcacgcatgaaaccgaacgtacgcgcacggctgatctggcgcataaacgcatcagcggagaagttcatcgcatagcgctggttgctggaatcaatagccggatggttaaaatcgatggtgaaatccagagaaaaaccattgtacggcttaaattcagcccacttatcgccatcttcgacacgaacagtctctttgatgcgaacaaatttcttggcgcagttcagctcgtcgataccggcgtcaagcagcaggtatacaaacggagcggcgctgccgtccatgatcgggatttccggcgcgttaacttcgataacaatgttatcgatgcccaagcccgcgagagcagcattgaggtgctctacggttgaaatccgtacatcatgctcgttgaccagacacgtacagagcatggtatcacgcacagatttggcatcggccgggaaatctaccggtggattcaagtcggtgcgacgatagatgaccccggtgttggccggcgcagggcgtaacgtcagggtgactttcttgccggtatgtaaaccgacacccgtcgcctgaacgatacgtttaagtgtcctttgtttgatcatcgtattatctcgccaaattacctatccaaccgaagtgtactatacattcggcgggccagtttagcacaaagagcctcgaaacccaaattccagtcaattcttaatcagcttgcttacgcaggaatgctgggatatccagataatctggctctttcgcagtttgcggcgcattgtcattcacgactttagcaaccggcttctgctcctgggtcagcggagccatcccgtgctgctggtagcgatccatcactggctgctgaacctgcttattggtcaccagagtgatttcaggacgtttgtccatgccgatacctgtcgcaacaacagttacgcgcagctcgtcattcatatccgggtcaagagaagtaccgataaccacagtcgcgttgtcggaagcaaatgcacggatggtgttacctaccgtttcgaactcatccagacgcaggtcgaagcccgctgtgatgttaaccagcacgccgcgcgcgccagacaggtcgatatcttccagcagcggagaagagatagccatttcagcagcttcttccgcacggtcttcaccgctcgccacgccagaacccatcattgcgtagcccatttcagacattacggtgcgaacgtctgcaaagtccacgttcatcaaacccggacgagtaatcagttcggcgataccttgtacagcacctttcagtacatcgttcgctgcgccaaacgcatccagcagggagataccgcggcccagaactttcagcagtttgtcgttcgggatagtgatcaaagagtccacatgcttggacagttcagtgatcccctgctccgcgaatgccatacgcttcttgccttcaaagttgaagggcttagtgacgacagcaacggtcaggatacccaaatcttttgccacttcagcgacgactggtgctgcacctgtaccggtaccaccacccatacccgcagcaataaagaccatgtctgcaccttccagcgccgcacgcagtgcatcgcgatcctcatcagccgcattgcggccaacttctggattagcgccagctcccagtcctttggtgataccgctaccgatttgaatcgtctgtccaaccgctgttttacgcagcgcttgtgcatcggtatttaccgcgaagaattcaacaccttcaatgcgctcgcgcaccatgtgttcaacagcattaccgccgccgccgccgacgccgatgactttaatcaccgcgtcattggtaagttccattggttcaaacatagtttctctccgatttgtgcctgtcgcctgaggccgtaatcatcgtcggcctcataaaaattaaaactcttttcgcagccaactattgagtcgcttgatccacgagccaactgatgctgtaacacgtttttctacttcagcttcaccgttaagatgtgactctttcccatagtgaagcaatcccaccgccgtcgaataatacggctcctgagcataatccgttaaaccggtaatgttcagcggcgcgccgatacgcacttgcgtatgaaacacgcgctgagcacaggctgcaagaccttcgatctgcgctgcgccaccagttaaaacaatgcctgccgccaggtgatgtttaaccccttgttggcgaagcttttcctgcaactgcaatatctcttcgttgaccagattgagcagctcggtatagcgcggctcgatcacctctgccagggtctgacgttgcagactccgcggtggacgaccgcctacgctcggcacttccacgctctcatcttttccaacgatggagcccagcgcacaaccgtggcgaactttaatcgcttcggcgtcacttggcggtgtgccaaaggcgtaagcgatatcactggtcacgacattgccagcataaggaattaccttcgtgtggcgcaatgccccaccggtataaacggcgatatccattgtaccaccaccgatatcgacaacgcagacacccagttcacgttcatcttccgtcaataccgaataacttgatgccagtccggcaaatatcagttggtcaactttcagcccacaacgttcaaccgctttgacgatgtttttcgccatatcgttgtgacatgtgatcaggtgcacttttgcctgcatccgcacgcccgaaagtcctaccggattcttgatcccttcctgatagtcaatcgcatactcttgcgggatcacatgcagcacacgatgctcatcgcgcacacgcaccgatttcgcggtatggacgacgttttccacatcttcttgcgtcacttcttcttcagaaataggcaccataccaatttcattctggcagctgatgtgcttaccagaaagcgccagatataccgaagagatctgacaatctgccatcaattctgcctggtcaatggcgcgttgtacgcacttgaccacggattcgaggtcgttcaccccgcctttatccataccacgcgacgggcagctgcccacgccaatgatattgaccataccgtcgggcagaacttcccctactaaagcggcaaccttcgcggtaccaatctccagtcctactaccagttttctgtccgtcgccttgatcattgttgttctgcctgtgcctgattttgttgctgagtagattcctctggcggcaagggcgcccagcctactgccgctccagagtcataacgcaaatcaacgtagctaatccgtttgccatcggtttgcgcctgctgctgtaaaaccggataaagttctacaaagcgagccaaacgtttcatcgtatcgccccggccaagattgagcttaatatcgttattcagcgtcaactgccaggaacgccgcgcggtcatcgccgcttccttcagagtaaatctgtcctttgccagcatctgccccatttcgcgatagccctgcaacacttcattggcgctgccttccgggccatacagcattggaagcacctgcttgctggtgcgatctggcggcacgctgaaagtgtttccttccgcgtctaccatatgttgatcattccaccgcgcaatcggcacatattcaaccagatgaatcttcaattcatcaggccactgctttctgacgctcacctgcttaatccacggcaggcgttgttctatttgcgtctggatgatgttgacatcctgggtcataaaggtacctggctcacccaatgccaggatcgactgccggatatcgtcattacgcgtgtaatggcgttcaccggtcaacaccagctttgagagcggcaggcgttgcgcatcttccatccagcccaacacgacccagccgctcaccaacactgtcgttaaaacggtcagcaggaaaaggatccccgccagacgcgttccattattgcggcgagaagaaacctcttcttcgctgtttcgcgtgttcagagcagcctgcgacatattagtccgccagttccagaattcgtactaccaactgcgagaagctcatacctgcctgacgtgccgccatcggtaccagactgtggctggtcatacccggtgaggtattggcttccagcagataaaactgtccatcgctgtccagcataacgtcaatacgtccccatcctttgcaacctaacgtcgtccatgcttttagcactaatgcctgcaaattggcctcttgtaacgcttccagacctgcggggcagaaatactgtgtctcatcagagagatacttcgcctcataatcatagaaggttccggccggttgaatacgtattgacggtaaaatttcttcaccgagtatcgcaaccgtgaactccggcccacttagccatttttcaatcaatacttcttcatcgtgctgaaatgccaatcttaatgcatcttgtagagcattttctgctactacttttgacattcccacactggaaccttcgcggctcggcttaacgataaccggcaaacctaaggcagaaatttctgctaactgcttatcgctcaggcctttttcaaactctgcgcgggttaatgctacccacggcgctaccggtaaaccagcgccctgccaaagcaatttgctgcgtagtttatccattgaaagcgcagatgccatcactccgctgccggtataaggcaagcccatcagctcgagcatgccctgcagcgtaccatcttcaccgccgcgaccgtgtagcgcgataaacactttctgaaaacccatcgacttcagttgcgtcacgtcgacttctttcgggtcgacaggatacgcgtcaataccgccttcacgcagcccggctaacaccgctgcgccagaattcagagaaacttcccgctcagcggaggtcccgcccaacaggaccgcgattttatcagtcatgttgttcttcctccggagtttgcggcttcagtttgatttcagctaaagaacgagcaatttttccgatattaccagccccctgaacgagaatcaggtcgttaccggttaataccggtgccagcatctcggctacctgcgccgggtccggcaccagaatgggatcaattttcccacgtccacgaattgtgcgacacagcgaacggctgtccgctcccggaattggcgcttcaccagccggatacacttccagcatcaacagggtatcaacctgcgtcagcacattggcgaaatcatcatacaggtcgcgcgtacgggtaaaacggtgcggctgaaacagcattaccaggtttttatccggccagcctgcgcgcgccgctttaatagtggcgtccacttccgtcgggtggtggccgtagtcatcgaccagcattgccgtaccgctttttccattcactggctctagcgggaattcaccgaggaaatcgaaacggcgccccgtcccctggaagctttccagcgcacgcaaaatagcctcgtcgtcaattccctcttccgtagcaaccgcaaccgcagctgcggcgttcagcgcgttatgacgacctggcgcattcagggtgacgtgcatcggctctttgtcctggcgcagcagcgtaaagtgcccctgcgggccaatctgctgataatcttctacacgcacgtcggcatcttcgctgaagccgtaagtcgtggtctgacgtcccacacgcggtaacaattcgcggatcaccggatcatcaacacacatcaccgcacgaccgtaaaacggcaggttgtgcagaaaattaataaaagtctgttttaaattctcaaagtcgccctggtaggtatccatgtggtcggcttcgatattggtgacaatcgccaccatcggttgcagatgcaggaacgatgcatcactctcatctgcttcggcaatcaggtaccgaccatgccccaaacgcgcatgaacccccgccgcttttaccagcccgccgttaacgaaggttgggtcgagccccgcttctgcgtagatgctggaaaccatcgcggtggttgtcgttttgccgtgtgttccggcaatggcgatgccatgacgaaaacgcattaactcagccagcatttcagcacgacggatcaccggaatacgcgcttcatgagctgcaacaatttccgggttatcggcagaaatcgcgctggaaacaacgaccacgctggcatcacgtacgttttccgggcgatggttgaaataaatcgtcgctcccagattcattaactgctgcgtgaccggatttggcgctaaatcggaaccactgatctgataaccttcattggccagaacttcggcaataccgcccataccggcaccaccgatgccgacaaaatgtatgtgccgaacgcgacgcatttcgggcacgatggaacgcagttttgccaattgttgtgtattcattctttacgccattaacttcttaaattcatacgatgcaaaaggcatcgctacaattacgcccgggcagcccggctcacttcatttgccactcgctcggtggcatccggaatggatgcagcgcgggcgcgttctgccatggttaataaggtttctcgcgaccacccggccagggtgttggcgacagcatccacgctaagctgtgactgctcgataattttggctgcgcccgctttttccagcggtagcgcattccagtattgctgacggtctttatgttgaaacggcacaaacaacgccggtagtcctgccgcggcgatttcactcaccgttaacgcaccggagcggcaaacgacgacatccgcccacgcatacgccgccgccatatcatcaataaattccgtcactttatgctgcggttgccccgcttcggcatacgcctgttcaacggattgttgcgaacctttgccgctctgatgccagatagtgactgaatcacccagtttcgcagcaacctgcggcattgtctggttaagaatgcgtgcgccctgggaaccacccactaccaacacacgaaccggaccttcacgtccagccaaacgttgctgcggcaacggcagcgccagcacatcggtacgcaccgggttacccaccacttccgcattaggaaaagcacctggaaacgcctgcatcactttggtagcaatcttcgccagccatttattggttaagcccgcaataccgttttgttcatgaagtacaaccggaatgcctaacgaccacgcggccagaccacctggacctgatacatagccgcccataccgagcaccacgtcaggtttgtacgctttcataatcgcccgcgcctgacgccaggcgttgaagatacgcagcggcgcagctatcagtgcttttataccttttccacgcagaccagagatacgaatgaaatcaatttcgatgccatgttttggcactaagtccgcttccatacggtcggcagtccccagccagcgaacttgccaaccctgagccattagatggtgcgcaaccgccagccccgggaatacatgtccaccggttccgcctgccatcaccattaatcgcttcccttgaccactcatcgtgaacctcgtacaaacgcctgcgctttctccagacgcgtttcataatcaatacgcaacagcatcatgatggctgtcgacataatcagtaagctcgaaccaccgtaactgatcagcggcaatgtcagacctttggtcggtaacatccccgccgccgcgcctacgttaaccagcgcctggaaactaaaccagataccaatagaacaggcgagaaaaccggaaaaacggtggtcaatttctaatgctttgcggccaatcgacatcgcgcgaaaagcgacgaagaataccattaaaagtgccagcaccacaccgacataccccagttcttcgccgataatggcgaaaataaagtcagtatgcgcttccggcagatactccagtttttgtaccgagttacctaaaccttgtccccacagttcaccgcgaccaaacgccatcaacgattgcgttaactgatagccgctgccaaagggatcttcccacggattccagaatgcggtaacacggcggatacggtacggttcggcgaggatcagcaacacaaccgctgaaatgcccataccgataatggcaatgaactgccacaatttcgctcccgccaggaacaacatcgccagcgtagtcacaaacaacaccaccaccgtaccaaggtctggctgtgccagcagtaacactgccaacaccagaattacgcccatcggtttcaggaagccgcgcaggttattacgtacttcgtcgcctttacgcaccagatagttggcgatatagcaaaacagcgacagttttgtcagctccgcaggctgaatacgcagcaaaccgagatcgatccaacgcgatgcccctttaaccgagctacccactaccagaacgatcatcagcaggatgatagatccgagcagcatcgtggcactgtagcgttgccagaactccatcggcagacgcagcgtaatgatcgccagaatgaatgccaggatcagatagacgccatcacgcttcgcgaagaagaacggatcgttggttaagcgttgccctatgggcattgacgccgaggtcaccatgataaagccaatcgccgcgaggccgaaggtcagccacagtaaggtgcgatcgtacatgatcaggctgtcggtatctttttcccgcgagcccatcacccagccctttagcgccgtggagatccagaccagaatactgaatcctggcaggcgcggcattttcaggcgagggagagataaacgcatcaacctaactccttcgccagacgggcaaactcattgcctcgttgttcaaagttcttgaattgatcaaggctggcacaggccggggagagcagaaccatatcgcccggctgaacacgcggagccagcaagcgcatcgcctgttccatggtttcggtttgttctgccacttccgggcgtagcgccgccagctgcgcgccgtcccgaccgaaacaatacagacgtacattatcgccattcaggtaacgcgccagtgggctaaagtccgccgatttaccatcgccccccagcaacaaatgcagcgtgccgtctacgtgcaggccattcagcgccgcttccgtactgccgacgttggtcgcttttgaatcgttaacccagcgcacaccgttatgctccagcacaacttcaaagcgatgcggcagaccagtgaatgtggttaacgctttcaggctgctggcacgcggtaaccctgcggcatctgccagcgccagcgccgccagcgcattggtgtagttatgctgcccggaaagtttcatttctttcacgttcagcactttctcgcctttcacccgcagccaggtttcgccctgctgatgattcaggtgatagtcgcccatgttgacgccaaagctgacgcagcgttcatccgcaccgcgaatcggcattgttaaggcatcatcagcattaaccacgcaaacttttgcgttttcgtaaatgcgcagttttgctgcacgatactgttgtaaaccaaacggatagcgatccatatgatcttcagtcacgttcagaatggtcgctgctaccgcctgtaagctggaggtggtttccagctggaagctcgacagttccagcacgtacagttcgcactcatcatccaacagcatcaacgcaggcaggccaatattgccacccacaccaacgttaacccccgccgctttcgccatttcacccactagcgtggtgaccgtgcttttgccgttagaaccggtaatcgccacaatcggtgcttgtgcttcacgacagaacagctcgatatcgccaacgatttcgattccggcatcagcggcagcgcttaaggatggatgcgccagtgcaataccgggactggcgacaatcagatctgccgccatcagccattcatcattcagaccgcccgtgtggcgttctacggcttcgggtaatttatccaggccaggcggtgtcatacgcgtatccataacgcgcggcgtcacaccgcgagcgaggaaaaagtccacgcaagaaagcccggtgaggcccaggccgataatgacgacatttttaccctggtaatcagccatgattaacgtaccttcagcgttgccagaccaatcaggaccagcatcagcgaaataatccagaaacgcacaatgacgcgcggttccggccagcctttcagttcatagtggtgatgaatcggtgccatgcggaaaatacgttgtccgcgcagtttaaaggagccgacctgcaggatgacggaaagcgtttctaccacgaacacgccccccataatcaccagcaggaattcctgacgcagcagtacggcgataatacctaacgcaccacctaacgccagcgaacctacatcgcccataaagacctgcgccggataggtgttaaaccacaggaagcccagccctgccccgactatcgcggtacagacaatgaccagttccccggcgtgtcgtagatacggtatgtgtaaatagctggcaaagttcatgttgccggtcgcccacgccaccagcgcaaaaccaccggcgacaaatacggtcggcataattgccagaccgtcgagaccatcggtcaggtttaccgcgttgccagtacccacaatgacaaagtaagccagcagaatgtagaacagccccagttgcggcatcacatctttaaagaacggaaccaccagctgcgttgcgggcgtgtctttgccggcaaggtacagcgcgaaggcaacacccagtgcaatgaccgacatccagaaatacttccaacgggcaatcaggcccttggtgtctttacgcaccactttgcgataatcatcaacaaagccaataacaccgtaacctaccagcaccaccagtacgcaccagacgtacggattggaggggtaagcccacagcagtacggagatcacaatcgccgtcaggatcataatcccgcccatggtcggtgtaccgcgcttgctgaagtgtgattcaggaccgtcgttacgcaccacctgaccaaaggaaagtttttgcaaatgagcaatcatacgcgggcccatccacaatgagatgaacagcgcggtcagcaggctgacgatggcgcgaaacgtcagataggaaaagacgttaaagccggaataatatttgaccaaatgttcggccagccaaactaacatgtcccattctcctgtaaagcgcgtactacctcttccatggcagcactacgtgaacccttaactaaaatcgtaattacctgttgctcagcaatcagtgatttaagacgcgcgataagcgcagttttatcggaaaaatgttcgccaacgccgctggcagtgctgatagcatggctttgtttacccacacttaacacgcagtcaataccagcagcttttgccgcttcgcccacctgtgcatggcaggcttcgctttcagcgcccagttccgccatatcgcccaccaccagcacgcggtagcccggcatttcagccagaacctgaacagcggcggtcattgaaccgacattggcgttgtaggagtcgtcgagcagcaactggttttctgccagttttatggggaacagacggcctggaacagctttcagatttgccagccccgctttgatagcatcaagcgttgcgcccacggacatggagagcgcagcggctgccagcgcattcgcaatattgtgacgccccggcaacggcagcagaacatcgacgctacctgtaggggtttgcagggtaaattccgtaccgtgcgaggttacatggatattggtggcggtgaaatcgctgttggcggcattaggtgagaaacgccacactttgcgtgagccaattacgctctgccagttcaaccagtcgttgttgtcggcgttcataatggcgataccgttttccggcaggccgctaaagatttcacctttcgctttcgcgacacccgcaagcgagccaaaaccttccagatgcgccgctgccaggttgttgaccagcgccgcttccgggcgagtcagactcacagtccaggcaatttcgccctgatggttcgcgccaagttcaataactgcgtaatcgtattccggcgttaagcgcaacagcgtcatcggtacaccgatgtcgttgttgagattgcctgccgtataaagtgtgttgccgcactggcttaaaatcgccgccgtcatctctttaacggaggttttgccggaggaacctgtcagagcaaccacgcgcgccggaacttgctggcgaacccatgcagccagttcaccaaacgccagacgcgtatccttgacgattaactgcggcagatcaatatccagcggacggctaaccagtagtgcgcctgcgccgccagctttcgcctggtcggcaaaatcatgagcatcgaaacgttcgcctttcagggcaacaaacaggcagcccggcgtcagttttcgcgtgtcagtggttacagcatcaagggtaatatctgcaccttgcagttcaccgttgagaatatcggtaagttggctaagggttacgctaatcatgcaatcacccccagcagacgcgccaccgtgacgcgatcggagtagtccagacgctgattgccaacaatctggtaatcctcatggcctttgcccgcgaccagtaccacatcattctctttagcctgcataacggcgcaagtcaccgcttcagcacggccttccatcactttggcatatccggcatctaacattcccgccagaatatcgttgatgatggcacgaggctcttcggtacgcgggttatcgtccgtcaccaccgccacgtcagcaaactcttcagcaattgcgcccatcagtggacgtttgcctttatcacgatcgccaccgcagccaaagacgcaccacagcttgcctgcacagtgcaggcgcgccgcctgtaaggctttttccagtgcatccggcgtatgcgcgtaatccaccaccaccgtcggtttgcctggtgcagtgaacacttccatacgtccgcaaaccggttgcagacgcgcggcggttttcagcaaatcagccagcggatagccgagtgccagcagtgtcgccagcgccagcagcaggttgctgacgttgaatgcgcccatcaggcgactttcaatttccccatcgccccaactcgagctaaagcgaatggtcgcaccgctgtcgtgatagttcacgtcggtcgctttcaaccagcgtccgtgacagttcggattgatatgatcttccattgataccgcaaccgcgtccggcagttttgccagccagcggcggcccacttcatcgtcggcgttaataatcgcctgaccgcaatgatgtgcagaataaagcagccatttcgcggcttcgtagtgttccatatcaccatgataatcaaggtgatcgcggcttaagttggtaaagaccgacgccgcaaatttcaatgccgccacacggtgttgtaccagcccgtgggatgaaacttccattgcgcaaaaagtcgcgccctgatccaccagccccgccagctcatgctgaacatcgactgccgaaccggttgtattttctgtcgggatcactttccccagcaggccgttaccaacggtgcccattaccgcgctggtttcgccaagcagttggctccactgcgccaacagctgggtagtcgtggttttgccgttggtgcccgttacgcccacgagacgtaaattgtcagagggttcatggtaaaagcggcccgccagtgcagataaacgctcgttgagctggctgagatagatgaccggtacgccgtgcatttcacggatttcaccgtcggtcgcctcatctttcgcctctgcaataatggcagccacaccttgcgctatcgcctgcgggatatatcgacgcccgtccgcctgatgacctactacagctacaaagagatcgcccgccgcagccacacggctgtcgagtgtcatctctcgcagtgctcgcgaaggtgcgtctggcacccacggagcaagaaggtcgcgcaaattacgatctgccacctgtaccctcgccttgattaatcacaaattcatttttatcgcccgttgtcagcgcatccggctcgatgttcatggtacgcaatacgccgcccatgatggcaccaaagaccggcgcggaaacggcgccgccgtagtatttacccgcctgcggatcgttgataacaacaaccagcgcgaagcgcggctgactcgcaggcgcaacgcctgcggtataagcaatatatttattgatgtagcgaccgtccggcccgacctttttcgcggtaccggttttaatggcgatacgatagcctttaatcgccgccttcacgccgccgccgcccggtagcgccacgctttccatcatatgcaccacggtgcgaacaatggattccgggaagacacgttcaccgggaaccggggggtcaactttggtaatcgacagtgggcgataaatgccgtagctgccgatagttgcgtagactcgcgctaactgtaacggtgttaccattagcccgtagccgaaagagaaggtggccctctctatgtcagaccaccgttgtttttgaggatataagccactgcgttctccgaccaaccccaaattggtcgcttttcccagcccaaaacgtgagtaagtatctactaacgctgaggacggcatcgctaacgccagtttggaaacaccgacgttactcgacttctgtaataccccggtcagggttaattcgctgtagcgtgccacgtctttgatttcgtggccgttaattcgataaggaacggtattgagtaccgagttttcccgcaccacgccacgttgcaacgcggtcatcaccaccatcggtttaaccgttgagcccggttcaaacacgtcggtgatggtacggttacgcatcgcttccttcggcgtgccgctcagattatttgggttgtatgacgggctgttagccatcgccagcacttcaccggtgttgacatccaccagcacggcgctaccagattcagccttgttaaaggccaccgcgttgttcagttcgcgataaaccagcgcctgcaggcgttcatcaatactcagcgtcaggttgtgcgctgcctggctgtcagtagaagaaatatcttcaattacgcgaccatagcggtctttacgcacaatgcgctcacccggctgcccggtaagccatttatcgaaactcttctcgacgccctcaatcccttggctatcgacgttagtaaagccgatgaggtgagcagtcacttcgccggatggataataacggcgagattcttcacgcagatgaatccccggcagtttcagttttttgatgtagtccgccatgtcagggtttacctgacgcgccagataaataaagcgccctttcgggttggcgttaatgcgggctgagagctgatccagcggaatattgagcgcgttagccagcgccttccagcggtcaccgacgctgataccgccagcgtcatgcacttctttcgggtcagcccaaatcgcttttactggcacactcaccgctaacgggcgaccagaacggtcagtaatcatgccgcgggaggtggaaacttgctgaacgcgaagagaacgcatgtcgccctctttcaccagcatatccggggagataacttgtaaccacgctacgcgtccgagcagaaaagccagcgccaggagaatacagccgcataacaacgcaaaacgccaactgataaagttggcatgttcttcctgacgttttggtttctgcgttttcgccgctgctttcatgcgtcgcgtttatccttatttttgcactacgatattttcttgtgacggatcaacatgctgcatttgcagcttttccgtggcgatcctttccacccggctatggtcgccgagcgcattctcttcaaggatcaggttgcgccattcaatgtctaaagcatctcgctccagcaccagttgttcgcgctgagcggtcagtaaacgggtatggtgcgccgtggttaccacggtcaccgccgtcaaaataatgcaaatgaacaggcagagtggcagcttcccaaatcgcaaaagatcgtcaccgataacaccaggcaatgcatggcgctcgtggcttcccatcgatcctttaactttgcttagagcttctgtcactctgctgatcatgcgttcgtcctctctgcaatacgcagaactgaactacgggcacgagggttctcagccacctcttcttcgcccggcattaacttgcctagtgctcgcagctgacggccacccagttttttgagctgctcttcagtcatcggtaaccctgccggaacttgcggaccgcggctgttttcacgcataaaacgtttcacaatacggtcttccagcgagtggaagctgatgatcgaaagccgcccccccggggccagcacgttgagcgagctttttagcgcctgctctatctcctccagttcactgtttacccaaatgcgcaccgcctggaaggtacgggtcgcgggatgtttaaacttatctttcaccggcgttgcggcagccacgacttccgccagttctttggtgcgggtcatcggctgttcgcggttacgctcgacaatggcgcgggcaatgcgtttggcaaaacgctcttcaccataggttttcaatacccaggcgatatcggcttcttctgcggtttgtagccattcagcggctgactgcccacgggttgggtccatacgcatgtccagcggaccatcgcgcataaaggaaaagccgcgctcagcatcatcaagttgcggtgaagagacgccaagatcgaggagaatgccgtcgatcttgccgataagatcgcgctcggcaacatattcgcccagcgcggagaaaggtccgtggatgatggagaagcgcggatcatcaatagtcttcgcaacggcgatagcctgcgggtcgcgatcgatcgccagcaaacgcccctcttcgccaagctgcgagaggatcagacgtgagtgaccaccgcgaccaaaagtcccatcaatgtagatgccatcaggacggatattgaggccattaacggcttcatccagcagcaccgtagtatgtttatagttttccatcattttatagagacaagtcctgcagtcgctccgataagtctccggtagccaactgctctgcgtcgatatcttccttgacctgttgatgccaggttgtttcatcccacagctcaaacttgttgaactgtccaaccagcatcacttcttttgtcagcccggcatgttgccgcagtactggcgcgattaacaatcgacctgcgccatccatctgacattcgctggcatgacctaacagtaggcgctgcacacggcgctcaaccgggttcatgctcgacagacgcgataatttttgctcgataatttcccattcaggcagggggtaaagcagcaggcacgggtgatgaatgtcaatggtgcaaaccatttgaccggcagcgttctcaagcagctgttcccgataacgggtaggcactgataagcgccctttgctgtcgagattgactaacgttgctccccggaacatgccagcctcaccccttattcccactttgccccacaatttcccactgaaaggagtttacggagcggaggaaaagcttgtcaagccagtcacaaggcataccgaggtaaaaaacccgatgtttacggctaatatcagcgttgtttattttacgtccaacgtgcgaagcaaattaacgttatgaatagctgtaagaaaaaatccctcatcgtcatcaccgttttaaaatgactcactattttccacagcaaatataaagtgtcagtttgcgacgcgagcggcattttaggacatatcttctctggttaacagtccctgttgcgtctgtgtggcgcttgatgccagcaggtttgcgcaaaaacaaagaaaagtgtttgttaaatcggcaattcatctctgcatgtaacaaaataatgcaaaaacgcgctgtcaatatcatttaattattgtgaatttcagcaggtgagttaattaacgggcgggtttaaaagcatttatcaataatagccaggaatagtcttatttactttaaggatattgatgtccattcccgtactcaacgcgccagagagaaattcacctggcgcgtacttttgttcgcggcttagctacggctgagcacgccgcggcgatagagattacgtttaatgcgcgttaaaccaggttttggcttacgcggttcgtccaggctcgccaggacaatctccagcacacgttctgcgacatcgcggtgacgttgagccactgccagcaccgggcactgtaagaagtcgagcagttcgttatcgccaaaggtggcaattgccaggtcagaaggcagtttgccgtcgcgacgtagcgtgacatccatcaccccttgcaacaacgcaaacgacgttgtgaacagcgcctgcggcatcggatgcgtttccagccatttttcgaataactgggcagctgcctcccgctcatagctgttggcataaaggaaatgcacttcgcgcggatcatctttccaggcagtacggaagccttgttcacgcaggaagctgacagaaagctccggcagcgcgccaagataaagcaccgtctcggcgggaaacttacgtaactcttccgccagcatttcggcatcatcctgatcggcaccaaccacgctggtgaagtgttcacgatcgagggcgcggtccagcgcgacaatcgggaacgggtcgttagcccagcgttgataaaaaggatgctcaggtggcaacgacgtcgaaacaataatggcatcaacctgacgctgtaaaaggtgctcaatgcagcgcatttcgttgtcgggctgatcttccgagcaggcaatcagcagttgataaccccgttgccgcgcctggcgttcaagatagttagcgatgcgggtatagctggtgttctccagatcggggatcacaagaccaatagaacgtgtgcgtccagcacgaagcccagctgccacggcgttcgggtgataattgtgctcacgcactactgccatgactttttcaacggttttgtcgctcacacggtattgcttcgctttgccgttaataacatagcttgcagtggtccgcgacactcccgccagccgagcgatttcatccagtttcacaattgccccttgcgtaaaatgtaaaaaccatagccattgtactggtatgggttaaattcattaacatctaagcgcagaaaattaactgcggcaactgcttttattccaggttcccactgatttcgcaaaaaaagcccaacgtgacatgttgggctgcaaattgcgcattgagatcattctcaacgcattattttatcgccgcgtgaaagtccgaccacaccagagcgagcaacttccacaattttcgccacatcgcgaatcgatgctaaaaatgcatcaagcttatcgctggtgcctgctaattgaacggtataaagcgagggtgtgacatcgataatttgcccacggaatatttccgtattacgtttcacttcgtcacgcccgtaaccgctggcctgaattttcaccagcatgatttcccgctcaacgtgcgcgccctgccccaactcgctcacgcgcaagacatcgaccagcttgtgtaattgcttttcgatttgctcaagcactttttcatcgcccacggtctgaatggtcatacgcgataatgtcggatcgtcggttggcgcaacggtcaggctttcaatgttgtagccacgctgggaaaaaaggccaatcacgcgggataacgcgcctgattcattttcgagtaagactgataatatccggcgcataatcaggttctctccgttttgcttaaccacatttcatccattccgcccccgcgaatctgcatcgggtagacgtgctcactgccatcgacggtaacatcaacaaacaccaagcgattattgcgcacctgttccagcgcctcgctaagtttgctttccagttcttgcggatgagagatctggatcccgacgtgaccataggcttccgccagacggacgaagtctggtaaggactgcatataagattgtgaatgacggccggaatagatcatgtcctgccactgcttcaccatccccagatagcggttattgagattcaccaccagtacgggcaactcatattgcaacgcggtagacagttcctggatgttcatctgaatactgccgtcaccagtgacgcaaaccacggtttcttctggcaacgccattttgacgcccagtgccgcaggtaaaccaaaacccatcgtgccgaggccgccagagttgatccagcgacgcggtttgtcgaatggataataaagcgcagcaaacatctggtgctgcccgacatcggacgtcacgtaagcgtccccattagtcaaccgccaaagagtctcgatcaccgcctgcggtttaatcttttcactgtgagtgtcatatttcaggcactgacgagcgcgccactgttcaatctgctgccaccagtcgcggatctcatccagcggttgatgggcggattcttgcgacaggagttcaagcatttgttcgaggacctggcgagcatcccccacaatcgggatatcagcagtcacggttttagaaattgaggttggatcaatatcgatatgcagaacagtggcatttgggcagtactttgccagattgttcgtcgttcggtcatcaaaacgtaccccgacggcgaaaatcacatccgcgttatgcatcgtcatattggcttcgtaggtaccgtgcattcccaacatgcccagtgcctggcgatgcgttgccggaaacgcccccagccccatcaaagaggaaacaacgggcagattcaacgcctccaccgcttctttcaactgcagatggcagcccgccgtgattgccccaccgcctacgtagacaaccggtttttttgccgccaccagcgtttgcagagcgcgcttaatttgccctttatgcccggaggtcgtgggattgtaagaacgcatactgaccgactccggccagacatagggtaatttgttcgccggatttagaatatctttcggtaaatcaacgaccacgggtccaggacgaccacttgccgctagccagaaagcctttttcagcacctgcggaatgtcttccgtttgcttaaccagaaaactgtgtttaaccaccgggcgagaaatccccaccatgtcgcactcctgaaaggcatcataacctatcaacgaagtcgctacctgcccggaaaggacaactaatggaatggaatccatataagcggtggcaatgccagtaatcgcattggtcgcccctggacccgacgttaccagcacgacgccgacttccccggtcgcgcgcgccagaccatcggccatatgcaccgccgcctgctcatggcgaactaaaacatgatcgataccacccacggtatgcaatgcatcgtaaatatcaaggaccgcgcctccaggataaccgaatacttgtttaacgccctgatcgataagcgatcggacgaccatctcggctccagacaacatctccatggccagcctcactgtttgacggaaaaaatgtgtaaaacacattaaccgtccgatcttgcttaagcaattggcagacagagacataaacacggggtaataagaataaacaggaggaaaggtgaaaagaaacgataaaatcctccattacagaggatgaaattgataataaatcggctgaatcctacaacttacagcaatttctctatttttttaattaatcctaaaatagagagcacaaacattcagaataaaattctacattcaataaaaaatgcagaataaaccagacattgatgtccgacctattctgcattcagttagcgcttgcaaattgagactaattgctcttccatccactgatggcctttatcgcgcccggcagcttcatgccaggagagataacaggttctgctgttttgttttaacggcagcggtaatacctgtaactctaaggattcagcgaactcttcagccaaccaacgcggcgcaatagcgaccagatgcgtttgcgacaccacgctaagtacgctcatcattgccatgccctgatacgcgatactggcttgcttatctaccgtgtcataccaggtttgactaaatgatgcgaaacgatcgagcgaaaccgcagcgtgttgttcgttataaacatcatgcttcagtaacgggcctttaattgttggatgatttttgctggctaccaacaccatttcatctttaaataatggcacactggtaaattcagggcgatggaagtcttcataactaatcacaaactccgtttcctgataacgcagctgatgttcagtgttctgatttaatgaagacttgaacataacatgtatatttggcgcaatctgctcaatgtgattataaatctgcgaggtcagaatgctgtctaacgggctgcaaacacaaagatgaaatacacgttcactgctcgcgggttcaaaacctgaaccaggcaattcattttgtactagttgcaatgcctgacgaactgagccaaaaagttgaaatgcgcgagcagtcggttgaataccacggccataacgaacaaaaagctcgtcattaaacatcaccttcaggcgtgcaacagcgttactgaccgcaggttgcgacattcccagagcatgagcggcacgggtgatgttttgctcctgcatcacggcatcgaaaacggttaataagttgagatcgaccatgcgtagctgtggcttgcttaactccgccgtctctggatgatctgtttgtacctctggcatacttaactccactgtcacacttaactccctttcccttattggaatgcagagaaataatcctcgagaatatgatttatcatgcatataaaataagaaaaagcaaaatgagtaaaattaggaaaacataaagatacaggttctgataaaaacagaatccactgccgagcaaagagtcattaactacagcataataatccataatgtttttgttgcgaaaacaatctaatcataactgccacgaatactcaatcatccacaaaatggattaaatgtgctttttaataattaatttatatgtttaatgcattaattcttaacattaattgatcaataatattcagcaaatgaatatcaaaaaattcgcaaaacatataattcaatacaaatcatcaggataggttttgtaacgcgtgcattttatccccctttccctcgttgattagatgcaaaaaattattctgaaatatgtcaaccgatgaaaagcatcggcggttaagcagaaattaatatcgcttgttttaaccaccgcagcacaattagctaattttacggatgccgaactcacaatggcgtgacgtttttattgcttcagggttgacatccgtttttgtatccagtaactctaaaagcatatcgcattcatctggagctgatttaatgactcacatcgttcgctttatcggtctactactactaaacgcatcttctttgcgcggtagacgagtgagcggcatccagcattaagccagcacgcagtcaaacaaaaacccgcgccattgcgcgggtttttttatgcccgaagcgaggcgctcaaaaagagacaaggacccaaaccatgagccagcaagtcattattttcgataccacattgcgcgacggtgaacaggcgttacaggcaagcttgagtgtgaaagaaaaactgcaaattgcgctggcccttgagcgtatgggtgttgacgtgatggaagtcggtttccccgtctcttcgccgggtgattttgaatcagtgcagaccatcgctcgccaggttaaaaacagccgtgtatgcgcgttagctcgctgcgtggaaaaagatatcgacgtggcagccgaatccctgaaagtcgccgaagccttccgtattcatacctttattgccacttcgccaatgcacatcgccaccaagctgcgcagcacgctggacgaagtgatcgaacgcgctatctatatggtgaaacgcgcccgtaattacaccgatgatgttgaattttcttgcgaagatgccggacgcaccccaattgccgatctggcgcgagtggtcgaagcggcgattaatgccggtgccaccaccatcaacattccggacaccgtgggctacaccatgccatttgagttcgccggaatcatcagcggcctgtatgaacgcgtacccaacatcgacaaagccattatttccgtacatacccacgacgatttgggcctggcggtcggcaactcactggcggcggtacatgccggagcacggcaggtagaaggcgcaatgaacgggatcggcgagcgtgccggtaactgttcccttgaagaagtcatcatggcgatcaaagttcgtaaggatattctcaacgtccacaccgccatcaatcaccaggagatatggcgcaccagccagttagttagccagatttgtaatatgccgatcccggcaaacaaagccattgttggcagcggcgcattcgcacactcctccggtatccaccaggatggtgtactgaaaaaccgcgaaaactacgaaatcatgacaccagaatctattggtctgaaccaaatccagctgaatctgacctctcgttcggggcgtgcggcggtgaaacatcgcatggatgagatgggatataaagaaagtgaatataatttagacaacctgtacgacgctttcctgaagctggcggacaaaaaaggccaggtgtttgattacgatctggaggcgctggccttcatcggtaagcagcaagaagagccggagcatttccgtctggattacttcagcgtgcagtcaggttctaacgatattgccactgccgccgtcaaactggcctgtggcgaagaagtcaaagcagaagccgccaacggtaacggtccggtcgatgccgtctaccaggcgataaaccgcatcactgactataacgtcgaactggtgaaatacagcctgaccgccaaaggccacggtaaagatgcgctgggtcaggtggatattgtcgccaactacaacggtcgccgcttccacggcgtcggcctggccaccgatattgtcgagtcctccgccaaagccatggtgcacgtactgaacaatatctggcgtgccgcagaagtcgaaaaagagttgcaacgcaaagctcaacacaacgaaaacaacaaggaaaccgtgtgatgtcgaagaattaccatattgccgtattgccgggggacggtattggtccggaagtgatgacccaggcgctgaaagtgctggatgccgtgcgcaaccgatttgcgatgcgtatcaccaccagccattacgatgtaggcggcgcagccattgataaccacggacagccgctgccgactgcgacggttgaaggttgtgagcaagccgatgccgtgctgtttggctcggtaggtggtccgaagtgggaacatttgccgccagaccagcaaccagaacgcggcgcactgctgcctttgcgtaaacacttcaaattattcagcaatctgcgtccggcaaaactgtatcaggggctggaagcgttctgcccactgcgtgctgacattgccgcaaacggctttgacatcctgtgtgtgcgcgaactgaccggcggcatctatttcggtcagccaaaaggccgcgaaggtagcggacaatatgaaaaagcgtttgataccgaggtgtaccaccgttttgagatcgagcgtattgcccgcatcgcatttgaatctgcccgcaagcgtcgccacaaagtcacctcaatcgacaaagccaacgtgctgcaatcctctattttatggcgggagatcgttaacgagatcgccacggaatacccggacgtcgaactgacgcatatgtacatcgacaacgccaccatgcagctgattaaagatccatcacagtttgacgtcttgctgtgctccaacctgtttggcgacattctgtctgatgagtgcgcaatgatcactggctcaatggggatgttgccttccgccagcctgaacgagcaaggttttggtctgtatgaaccggcgggcggctcggcacccgatatcgcaggtaaaaatatcgccaacccgattgcacaaattctgtcgctggcgctgctgctgcgttacagcctggatgccgatgatgcggcttccgccattgaacgcgccattaaccgcgcattagaagaaggcattcgcactggggatttagcccgtggcgctgccgccgttagtaccgatgaaatgggcgatatcattgcccgctatgtggcagaaggggtgtaatcatggctaagacgttatacgaaaaattattcgacgctcacgtagtgtacgaagccgaaaacgaaaccccgctgttatatatcgaccgccacctggtgcatgaagtgacctcaccgcaggcgttcgatggtctgcgcgcccacggtcgcccggtacgtcagccgggcaaaaccttcgccaccatggatcacaacgtctctacccagacgaaagacattaatgcctgcggtgaaatggcgcgcatccagatgcaggagctgatcaaaaactgcaaagaatttggcgtcgagctgtatgacctgaatcacccgtatcaggggatcgtccacgtaatggggccggaacagggcgtgaccttgccggggatgaccattgtctgcggcgactcacataccgccacccacggcgcgtttggcgcactggcctttggtatcggcacttccgaagttgaacacgtactggcaacgcaaaccctgaaacagggccgggcgaagaccatgaaaattgaagtccagggcaaagccgcgccgggcattaccgcaaaagatatcgtgctggcaattattggtaaaaccggcagcgcaggcggtaccgggcatgtggtggaattttgcggcgaagcaatccgtgatttaagcatggaaggtcgtatgaccctgtgcaatatggcaatcgaaatgggcgcaaaagccggtctggttgcaccggacgaaaccacctttaactatgttaaaggccgtctgcatgcgccgaaaggcaaagatttcgacgacgccgttgcctactggaaaaccctgcaaaccgacgaaggagcaactttcgataccgttgtcactctgcaagcagaagagatttcgccgcaggtcacctggggcaccaatccaggccaggtgatttctgtgaacgacaatattcccgatccggcttcgtttgccgatccggttgaacgcgcgtcggcagaaaaagcgctggcctatatggggctgaaaccgggtattccgctgacagaagtggctatcgacaaagtgtttattggttcctgtactaactcgcgtattgaagatttacgcgcggcagcggaaatcgccaaaggccggaaagtcgcgccaggcgtacaagcgctggtggttcccggctccggtccggttaaagcccaggcggaagcggaaggtctggacaaaatttttatcgaagctggttttgaatggcgcttgccaggttgttcaatgtgcctggcgatgaacaacgaccgcctgaatccgggcgaacgttgcgcctccaccagcaaccgtaactttgaaggccgccaggggcgcggcgggcgcacgcatctggtcagtccggcaatggctgccgccgcggctgtgaccggacatttcgccgacattcgcaacattaaataaggagcacaccatggcagagaaatttatcaaacacacaggcctggtggttccgttggatgccgccaatgtcgataccgatgcaatcatcccgaaacagtttttgcagaaagtgacccgtacgggttttggcgcgcatctgtttaacgactggcgttttctggatgaaaaaggccaacagccaaacccggacttcgtgctgaacttcccgcagtatcagggcgcttccattttgctggcacgagaaaacttcggctgcggttcctcgcgtgagcacgcgccgtgggcattgaccgattacggttttaaggtggtgattgcgccgagttttgctgacatcttctacggcaatagctttaacaaccagctgctgccggtgaaattaagcgatgcaaaagtggatgagctgtttgcgctggtgaaagccaatccggggattcattttgatgtagacctggaagcgcaagaggtgaaagcgggagagaaaacttatcgctttaccatcgatgccttccgccgccactgcatgatgaacggtctggacagcatcggcctgactctgcagcacgacgacgcaattgcgtcttatgaagagaagcaaccggcgtttatgcgttagtttgtacaccgtccggcactcaatcgccaaaaagaaaaaagccagcagataatcactgctggcgtggcgattaacaccaatactcagtcacacatgatgtccgcaaatcagtagtcagaatgactcccctcccactgcatcagttcttcaagcatggttaatcgttgtgggacgcttaaccaacgcaaccagcacaacttcgctgtcgcggtaaaatagtgctgataaaactgacgcatggggcacctccttgcttcatcgttaggaattattgacttaatatagggaaaataaaattgctgtcttttgcgcaggagttccccttttatgccatctgctcgtctgcaacaacagttcatccgcctgtggcaatgctgcgagggtaaatctcaggagaccactctcaacgaactggcagcgttactgagttgctcgcgtcgtcatatgcgcaccctgctcaacaccatgcaggatcgcggctggctgacgtgggaagcggaagtcgggcgcggtaaacgttcacgcctgacattcctctataccgggctggcgcttcagcaacagcgggcggaagacctgctggagcaggatcgtatcgaccaactagtgcagttggttggcgacaaagcgactgtgcggcaaatgctggtttctcatttgggccgcagcttccgccagggacggcacatcctgcgcgtgctctactatcgtccgttgcgtaatctgctacctggcagcgcattgcgccgttctgaaacccatatcgcccggcaaatcttcagttcgctaacgcgcataaatgaggaaaatggggaactggaagcagacatcgcccaccactggcagcaaatatcaccgcttcactggcgtttctttttgcgtccaggtgtccattttcaccatggtcgtgaactggaaatggacgatgtgatcttctctttaaaacgaatcaatacgcttccgctctattcgcatattgctgacattgtgtcgccgacgccctggacgctggatatccatctcacgcaaccggaccgctggttgccgttactgctggggcaagttccggcaatgatcctgccgcgcgaatgggaaaccctcagtaactttgccagccatcccatcggcaccggtccgtatgcggtgatccgcaacagcaccaatcaactgaaaattcaggcattcgatgacttcttcggttaccgggcattaatcgacgaagttaacgtctgggttctgccggaaattgccgacgagccagccggagggctgatgctaaaaggtccacagggcgaggaaaaagagattgaaagccgcctggaggaaggttgctactatttactgttcgacagccgcacccatcgaggggcgaatcagcaagtcagagactgggtaagctatgtgctttctccgacgaatctggtctatttcgctgaggaacagtaccagcaactgtggttcccggcttatggactgctcccccgttggcaccatgcccgcatcataaagagcgaaaaaccggctggtctggaaagcctcaccctgaccttttatcaggatcacagcgagcatcgggtgattgccgggatcatgcagcagattctggcaagtcaccaggtcacgctggaaatcaaagagatcagctacgatcagtggcatgaaggagagatcgagagcgatatctggcttaacagcgccaactttacgctgccgctggatttttcgctgttcgcgcacttgtgcgaggtgccgctgctccaacactgtattccgatcgactggcaagccgacgccgcccgctggcgcaatggcgaaatgaacctggcgaactggtgccaacaactggtcgccagcaaagcaatggtgccacttatccaccactggctgatcattcaggggcaacgtagtatgcgcggcctgcgcatgaacaccctcggctggttcgattttaaatcagcgtggtttgcaccaccggatccatgattgctggttgataacaaaatcactacactaacgccgttctcaacggggtgccacgcagccgcgtgcgctgagaaaatacccgtcgaacctgatccggataacgccggcgaagggatttgaggctccttctcaagtcctttgccactcttttgtgaggtgcaaagtgttaaaaaaatgtcttcccctgctgttgctgtgcacagcgcctgttttcgctaaacctgttctgactgtttatacctacgattcctttgccgctgactggggacctggtccggtagtcaaaaaagcctttgaagcagactgtaattgcgaactgaaactggtggcgctggaagatggcgtttcgctgctcaaccgtctacggatggaaggcaaaaacagcaaagccgatgtggtgctggggctggataacaatctgttagacgccgccagcaaaacagggctgtttgctaaaagcggtgtggcagcggaagccgttaacgttcctggcggctggaataatgacactttcgtaccgtttgattacggctatttcgccttcgtctatgacaagaacaaactgaaaaatccgccgcaaagcctgaaagaactggttgagagcgatcagaactggcgggtgatttatgaagatccacgtaccagtacgccggggctgggtctgttgctatggatgcaaaaagtctatggcgataacgccccgcaagcctggcagaaactggcgaagaaaactgtcacggtcaccaaaggctggagcgaagcctacggcctgtttttaaaaggcgaaagcgatctggtactgagttacaccacctctccggcttatcacattctcgaagagaagaaagataactacgccgccacaaactttagcgaaggtcactatctgcaggtggaagttgccgcccgcaccgctgccagcaagcagccagagctggcgcaaaaattcctccagtttatggtttctccggcttttcagaatgcgatcccaaccggcaactggatgtatccggtagcaaacgtcactctgcctgcaggatttgaacaattgaccaaaccagccaccacgctagagttcacacccgccgaagtggcggcacaacgtcaggcatggattagcgaatggcaacgcgccgtcagccgttaattcccggctggttaattccaggcgtaagcgccgccacgctggtggtagcggttgcactggcggcgtttctcgccctgtggtggaacgcgccgcagggtgactgggtggcagtctggcaggacagctacctgtggcatgtggtgcgcttctccttctggcaggcgtttctctcggcgcagctctctgtcgtacccgcaatattcctcgcccgcgccctctatcgcaggcactttcctgggcgacagatgctgttgcgtctgtgcgcaatgaccttgatcctcccggtgctggttgctgttttcggcattcttagcgtctatggtcgccagggctggctggcctcgctctggcaatcacttggtctggagtggaccttttcgccctacggcctgcaaggcattttgctggcccatgtgttttttaatctgccgatggctagccgtttattactccaggcactggaaaacattcccggcgaacaacgtcagcttgccgcccaacttgggatgcgcggctggcattttttccgtttcgtcgaatggccgtggttacggcgacaaatcccgccggttgccgcactaatctttatgctctgtttcgccagcttcgccaccgtgctatcgctgggcggcggtccgcaggcgaccactatcgagctggcaatctatcaggcactgagttacgactacgatcctgcccgcgcggcaatgctggcgctgatccagatggtgtgctgcctcgggctggtgctgttgagtcagcgattgagtaaggccattgcgcctggtaccacactgctgcaaggctggcgcgacccggacgatcgtctgcatagtcgcatttgcgacacggcgttaattgtgctggcgctgctgctgttgctgccaccgttactggcggtgatcgtcgatggggtaaatcgccagttgccggaagtgctggcacaaccggtgctgtggcaggcgctgtggacctcgttgcgtattgcgctggcggcaggcgtattgtgcgtagtgctgaccatgatgctgctatggagcagtcgcgaacttcgggcgcggcagaaaatgctggcgggtcaggcgctggagatgagcggcatgttgatcctcgccatgccggggattgtgctggctacgggcttctttttactgctcaacaacactatcggcctgccgcaatctgctgacggcattgtgattttcaccaatgcgttaatggcaatcccttatgcgctgaaagtactggaaaacccgatgcgcgatatcaccgcccgctacagcatgttgtgtcagtcgctgggcattgaaggctggtcacgcttaaaagtggtggagctgcgcgccctgaaacgtccactggcgcaggcgctggcctttgcttgtgtgctgtcgattggtgattttggcgtggtggcattgttcggtaacgatgatttccgtaccctgccgttttatctctaccagcaaattggctcctatcgcagccaggacggcgcggtcaccgcgttaattctgctgctgctctgttttctgctgtttaccgtgattgaaaaaataccggggcgaaatgttaaaactgactgatatcacctggctttaccaccatttgccgatgcgttttagcttaacggtggaacgcggcgagcaggtggcgatcctcgggccaagcggcgcgggtaaaagtaccctgcttaatttgatcgccggttttctgacgccagccagcggtttgctgactatcgacgacgtagatcacaccacgacgccgccgtcacgccgtccggtgtcgatgctgtttcaggagaacaacctgttcagccacctgacggtcgcgcagaacatcgggctggggctaaatccggggttgaaactaaatgcggcgcagcagaagaaaatgcacgcgattgcccaccagatggggattgataatttaatggcgcggttacctggcgagctttccggcggtcaacgacagcgcgtggcgttagcgcgttgtctggtacgcgaacagcccattttattgctcgatgaaccgttttccgcgctcgatccggcgctacgtcaggagatgctgacgctggtgagcacgagctgccaacagcaaaaaatgacgctattgatggtgtcgcacagtgtggaagatgcggcgcggatcgccacgcgctcggtggtggtcgccgacgggcgtatcgcctggcagggtaagaccgatgagttgttgagcggtaaggcgagtgcttcggcgctgttgggaattaaaggttaatatgcactgtcggatgcggcgtgaacgccttatccgacctacaggtagtgcgttttgtaggcctgataagacgcggcaagcgtcgcatcaggcaacccgcacaaggctatcctctaaaccccaaccactttacgcaaaatatcgatatacaccggcatcaacgggtggcgaattaacaccaccagcgccaccacgccgatggcagaaatcaacggcgtcagccacaacaaacgaccgcgggacaaataatgactcaaacggtcagtcgctttaccgctgcgccataaccgccagcacagccagcctccaacccacaaaaacaccgctgttgccagcagcaaccatttaaactcaccgctctgcatcccggcaggaatatcgatcgccgcacccgccagaatccccggcaggaagtaaaacggtggccacagcaagcagccgataatattcggcgtaataaattttgccaccgggagatccagcattcccgccaccattggcaccagcggacgcgtcgggccgacaaaacgaccgaccagaatggtgaacatgctgtgctgatgcagcgcatgttcggttttatcgagtaatgctttgttcttcttcagaaatgaccagcgatgcaacggctttttaaaacgccagcccagccagaaggagatccagtcgcccagcaggcagccaataatccccgccagccaggcgtaccagaaacttaactcaccgctgccaatcagtgctcccagccccgccatcagcaccgtaccgggtagaatcaaaccgaccagcgccagcgactccagaaaggccaccaataacaccgccatcaatgaatacacggtggattgggtaataaagtgttccagcaatgcttgcataatgtgcctgtcaaatggacgaagcagggattctgcaaaccctatgctactccgtcaagccgtcaattatctgattcgttaccaattatgacaacttgacggctacatcattcactttttcttcacaaccggcacaaaagacaccctctgcctatcattcgatagtctcaaaatattccacctgcagagaatcacggtgctcaatgatgcaataacgctggaaattatttgcataatcacttttatcatgaaaaaaccatatacaatcgttttgtagactcggtcccattcttttcaaaaaatctattagctttgctttctgaagaaaaatgttatctatatttcgccatgtaacaatcactcttgtttgcatatcatcaacattatagtaatagctatactcggctacgtttgatatgtttggcaaatttcgcaaactctctggcgtataaaggaaaaatggggaaagttcatgctgtgtatagtgatgttcctttgacatcaatgagatataagcatagaaaaatataaagaataaaactaaaaatgataataaaatataaatatattttgacatctctactcacgacctgtgcggataatgagggtttaagaaaagaaaaagcggtctttcaaagggagattctgaaaactttatagctcccgaacttgataatgaactatacaactcatgatttattctgtttttatctttataataattagtaacaggtctattattatattgattatataacaatgttgaaaaagactcatctaatggctttatataatttaaccattctggaagcttcttttttattagttgatttttttaaaaggaggatgggttgtaaataagaatggcgtaaactcagtatttttaaaattccctggcgctccatatgtatcccatatttgtaaggcttttgtgtaagataaaggttttgccaataaaagtggatcggggcctgttccaaatacacgataaaaaccaatcaagtctgagactaaatcttctgcactaaatccgctatcagtataccagttaaaaataaatgagttttgccatgcttcaaacctcttcgcagttccatacattaacgttaaggcaactcttgctttaagagtgggtgaaagacatgaacgaaccataaccttcgtataaacaccggtatgaaatgtaagatctactcctaatatttttttccgaattcccatttcctgatgataatcaacaggaaaataccaatcatgaaattcatcgtaatatgttgaaaaatgttcttgctccaattttctttttaatattctggcatcttgtccctgagcatgccccaaatcgatccaacctaactcttcggtataaactaatccatactttttcgttgttgcaaatattccatcagtaatatcgttacgtttgctcatcacaatctcccctcaaaaaaaacgtatagcaaataatatcaataaggaaaaatattatttttcaatatttttttgtatacaattcattttatgaatgaatttacaaagatagctgcgcctgatgccgctacacttttgccagaccatgttctcctctgagggagtaactggcgtttttcatagaatgccgtacttttttcaacaactgccacatcgaacggcatttatggtggcgtgaagtgcctgccataaccgctcaatgtggtgttcctacgatgaacaaaccgcttgatatattctcctgatgcaaccggacaatatgttcatgatgggtatcccgatacataagccttcgttttatttttacaaaaagaaatcgttgtcgatattttatcaagaaaaaaataattcaggtaaaacgattcaactaaaaataactaaaattaatcccccgtgaaatatataaataacgtcagatgaagaaagcaagggggttcccccccttctttcttattattcacaacctgccctaaactcgctcggactcgccccggtgcattttttaaatactcgcgagaaatagagttgatcatcaaaaccgacattgcgaccgacggtggcgataggcatccgggtggtgctcaaaagcagcttcgcctgactgatgcgctggtcctcgcgccagcttaatacgctaatccctaactgctggcggaacaaatgcgacagacgcgacggcgacaggcagacatgctgtgcgacgctggcgatatcaaaattactgtctgccaggtgatcgctgatgtactgacaagcctcgcgtacccgattatccatcggcggatgaagcgactcgttaatcgcttccatgcgccgcagtaacaattgctcaagcagatttatcgccagcaattccgaatagcgcccttccccttgtccggcattaatgatttgcccaaacaggtcgctgaaatgcggctggtgcgcttcatccgggcgaaagaaaccggtattggcaaatatcgacggccagttaagccattcatgccagtaggcgcgcggacgaaagtaaacccactggtgataccattcgtgagcctccgaatgacgaccgtagtgatgaatctctccaggcgggaacagcaaaatatcacccggtcggcagacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcgttaaacgagtatcccggcagcaggggatcattttgcgcttcagccatacttttcatactcccgccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatccagcctgacgctttttttcgcaactctctactgtttctccatacccgtttttttggatggagtgaaacgatggcgattgcaattggcctcgattttggcagtgattctgtgcgagctttggcggtggactgcgccaccggtgaagagatcgccaccagcgtagagtggtatccccgttggcagaacgggcaattttgtgatgccccgaataaccagttccgtcatcatccgcgtgactacattgagtcaatggaagcggcgctgaaaactgtgcttgcagagcttagcgtcgaacagcacgcagctgtggtcgggattggcgttgacacaaccggctcgacgcccgcaccgattgacgccgacggtaacgtgctggcgctgcgcccggagtttgccgaaaacccgaacgcgatgttcgtattgtggaaagaccacaccgcggttgaagaagcggaagagataacccgcttatgtcacacgccgggcaacgttgactactcccgctatattggcggtatttattccagcgaatggttctgggcaaaaatcctgcatgtgactcgccaggacagcgccgtggcgcaatctgccgcatcgtggattgagctgtgcgactgggtaccagctctgctttccggtaccacccgcccgcaggatattcgtcgcggacgttgcagcgccggacataagtcgctatggcatgaaagctggggcggcctgccgccagccagtttctttgacgaactggacccgatcctcaatcgccatttgccttccccgctgttcactgatacctggactgccgatattccggtgggcacgttatgtccggaatgggcgcagcgtctcggcctgcctgaaagcgtggtgatttccggcggcgcgtttgactgccatatgggcgcagttggtgcaggcgcacagcctaacgcactggtaaaagttatcggtacttcgacctgcgacattctgattgccgacaaacagagcgttggcgagcgggcagtgaaaggtatttgcggtcaggttgatggcagcgtggtgcctggatttatcggtctggaagcaggccaatcggcgtttggcgatatctacgcctggttcggtcgcgtactcggctggccgctggaacagcttgccgcccagcatccggaactgaaagatcaaatcaacgccagccagaaacaactgcttccggcgctgaccgaagcatgggctaaaaacccgtctctggatcacctgccggtagtactcgactggtttaacggtcgtcgcacgccaaacgctaaccaacgcctgaaaggggtgattaccgatctgaacctcgctaccgacgctccgctactgttcggcggtttaattgccgccaccgcctttggcgcacgcgcaattatggagtgcttcaccgatcaggggatcgccgtcaataacgtgatggcactgggcggcatcgcgcggaaaaaccaggtcattatgcaggcctgctgcgacgtgctgaatcgcccgctgcaaattgttgcctctgaccagtgctgtgcgctcggtgcggcgattttcgctgccgtcgccgcgaaagcgcacgcagacatcccatcagcccagcaaaaaatggccagtgcggtagagaaaaccctgcaaccgtgcagcgaacaggcacaacgctttgaacagctttatcgccgctatcagcaatgggcgatgagcgccgaaaaacactatcttccaacttccgccccggcacaggctgcccaggccgttccgactctataaggacacgacaatgacgatttttgataattatgaagtgtggtttgtaattggcagccaacatctgtatggcccggaaaccctgcgtcaggtcacccaacatgccgagcacgtcgttaatgcgctgaatacggaagcgaaactgccctgcaaactggtgctgaaaccgctgggcaccacgccggatgaaatcaccgctatttgccgtgacgcgaattacgacgatcgttgcgctggcctggtagtgtggctgcacactttctccccggccaaaatgtggatcaacggcctgaccatgctcaacaaaccgttgctgcaattccacacccagttcaacgcggcgctgccgtgggacagcatcgacatggactttatgaacctgaaccagaccgcgcatggcggtcgcgagttcggcttcatcggcgcgcgtatgcgtcaacaacatgccgtcgttaccggtcactggcaggataaacaagcacatgagcgtatcggctcctggatgcgtcaggcggtctctaaacaggatacccgtcatctgaaagtctgccgttttggcgataacatgcgtgaagtagcggtcaccgatggcgataaagttgccgcacagatcaagttcggtttctccgtcaatacctgggcggttggcgatctggtgcaggtggtgaactccataagcgacggcgatgttaacgcgctggtcgatgagtacgaaagctgctacaccatgacacctgccacacaaatccacggcgaaaaacgacagaacgtgctggaagcggcgcgtattgagctggggatgaagcgtttcctggaacaaggtggcttccacgctttcactactacctttgaagatttgcacggcctgaaacagcttccgggtctggccgtacagcgtctgatgcagcagggctacggctttgcgggcgaaggcgactggaaaactgccgccctgcttcgcatcatgaaggtgatgtcaaccggtctgcagggcggcacctcctttatggaggactacacctatcacttcgagaaaggtaatgacctggtactcggctcccatatgctggaagtctgtccgtcgatcgctgtggaagagaaaccgatcctcgacgttcagcatctcggtattggcggtaaagacgatcctgcccgcctgatcttcaacactcaaaccggtccagccattgtcgccagcctgattgatctcggcgatcgttaccgtctgctggttaactgcatcgacacggtgaaaacaccgcactccctgccgaaactgccggtggcgaatgcgctgtggaaagcgcaaccggatctaccaaccgcttccgaagcgtggatccttgctggtggcgcgcaccataccgtcttcagccatgcgctgaacctcaacgatatgcgccagtttgccgagatgcacgacattgaaatcacagtgattgataacgatacccgccttccagcgtttaaagacgcgctgcgctggaacgaagtgtattacggatttcgtcgctaagtagccgcatcaggtatgtaacgcctgatgcggcgctggcgcgtcttatcaggcctacgcgttccggatttgtaggccggataagcaaagcgcatccggcattcaccgcctgatgcgacgccgacgcgtcttatcaggcctacacgctgcgattttgtaggccggataagcaaaacgcatccggcacgaaggagtcaacatgttagaagatctcaaacgccaggtattagaagccaacctggcgctgccaaaacacaacctggtcacgctcacctggggcaatgtcagcgccgttgatcgcgggcgcggcgtcctggtgatcaaaccttccggcgtcgactacagcatcatgaccgctgacgatatggtcgtggtcagcatcgaaaccggtgaagtggttgaaggtacgaaaaagccctcctccgacacgccaactcaccggctgctctatcaggcattcccgtctattggcggcattgtgcacacacactcgcgccacgccaccatctgggcgcaggcgggtcagtcgattccagcaaccggtaccacccacgccgactatttctacggcaccattccctgcacccgcaaaatgaccgacgcagaaatcaacggtgaatatgagtgggaaaccggtaacgtcatcgtagaaaccttcgaaaaacagggtatcgatgcagcgcaaatgcccggcgtgctggtccattctcacggcccgtttgcatggggcaaaaatgccgaagatgcggtgcacaacgccatcgtgctggaagaagtcgcttatatggggattttctgccgccagcttgctccgcagttaccggatatgcagcaaacgttgctggataagcactatctgcgtaagcatggcgcaaaagcctattacggccagtaatgactgtataaaaccacagccagtcaaccaaaaccaggctatactcaagcctggttttttattggattttcagcgtggcgcaggcaggttttatcttaacccgacactggcgggacaccccgcaaggaaccgaagtttccttttggttagcgacggacaacgggccgttgcaggttacgcttgcgccgcaagagtccgtggcgtttattcccgccgatcaggttccccgcgcccagcatattttgcagggtgagcaaggctttcgcctgacgccgctggcgttaaaggattttcatcgccagccggtgtatggcctttactgtcgcgcccatcgccagttgatgaattacgaaaagcgcctgcgtgaaggtggcgttaccgtctacgaggccgatgtgcgcccgccagaacgctatctgatggagcggtttatcacctcgccagtgtgggtcgagggtgatatgcgcaacggcgctatcgttaatgcccgtctgaaaccgcatcccgactatcgtccgccgctcaagtgggtttctattgatattgaaaccacccgccacggtgagctgtactgcatcggcctggaaggttgcgggcagcgtatcgtttatatgctggggccagagaatggcgacgcctccgcgctcgattttgaactggaatacgtcgccagccgcccgctgctactggaaaaacttaacgcctggtttgcgactcatgatcctgatgtgatcatcggttggaacgtggtgcagttcgatctgcgaatgctgcaaaaacatgccgagcgttaccgtattccgctgcgtctggggcgtgataacagcgagctggagtggcgcgagcacggctttaaaaacgacgtcttttttgctcaggccaaagggcgactgattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataagcctgcgctggcaacttataacctgaaagattgcgagctggtgacgcagatcttccacaaaactgaaatcatgccgtttttgctcgaacgggcgacggtgaacggcctgccggtagatcgacacggcggttcggtggcagcgtttggtcatctctattttccccgtatgcatcgcgctggttatgtcgcgcctaatctcggcgaagtgccgccgcacgccagccctggcggctacgtgatggattcgcgacctgggctttatgattcggtgctggtgctggactacaaaagcctgtacccgtcgatcatccgcacctttctgattgatcccgtcgggctggtggaaggcatggcgcagcctgatccagagcacagtaccgaaggttttctcgatgcctggttctcacgggagaaacattgcctgccggagattgtgactaacatctggcacggacgcgatgaagccaaacgtcagggtaataagccgctttcgcaggcgctgaagatcattatgaatgccttttatggtgtgctcggcaccaccgcctgccgtttcttcgatccacgcctggcatcgtcgatcaccatgcgtggtcatcagatcatgcggcaaaccaaaacgttgattgaagcgcagggctatgatgttatctacggcgataccgactcaacgtttgtctggctgaaaggtgcacattcggaagaagaagcagcgaaaatcggtcgtgcactggtgcagcacgttaacgtctggtgggcggaaacgctgcaaaaacaacggctgaccagcgcactggaactggagtatgaaacccatttctgccgttttctgatgccaaccattcgcggggccgataccggcagcaaaaagcgctacgccggactgattcaggagggcgacaaacagcggatggtatttaaagggctggaaaccgtgcgcaccgactggacgccgctggcccagcagtttcagcaggagctgtacctgcgtatcttccgcaacgagccatatcaggaatacgtgcgcgaaaccatcgacaagctgatggcgggcgaactggacacgcagctggtttaccgtaaacgccttcgccgtccgctgagcgaatatcagcgtaatgttccgcctcatgtacgcgccgctcgccttgccgatgaagaaaaccataagcgcggtcgccccttgcaatatcagaaccgcggcaccattaagtacgtatggaccaccaacggcccggagccgctggactaccaacgttcaccactggattacgaacactatctgacccgccagctacaacccgtggcggagggaatactcccttttattgaggataattttgctacacttatgaccgggcaacttgggctattttgagcaaaaaaaagagttcgccagataccattttgatgcgtgacgaatgctttgccatccagtaccatagcgccctttccattcctggacctgaataacaccactacctcataagcacggtagcgggtggttattgcctgcaattaaagatatagagccgaacacatatgccttttacacttggtcaacgctggatcagcgatacagaaagcgaattgggacttggaaccgttgtcgcggtggatgcgcgaactgtcactttacttttcccatctactggtgaaaaccgtctgtacgcacgcagtgattcccccgtgacccgcgtgatgttcaaccctggtgataccattaccagccatgacggctggcagatgcaagtcgaagaagtaaaagaagaaaatggcttgctgacctatatcggtactcgccttgatactgaagagtccggcgtagccctgcgtgaagttttccttgatagcaaactggtgttcagcaaaccgcaggaccgtctgtttgccgggcagattgaccgtatggaccgctttgcgctgcgttatcgcgcgcgtaagtattccagcgaacagttccgtatgccgtacagcggcctgcgcggtcagcgtaccagcctgatcccgcaccagctcaacatcgctcatgatgttggtcgccgccacgcgccgcgcgtcctgctggctgacgaagtgggtttagggaaaaccattgaagccgggatgatcctgcatcagcaactgctctctggcgctgctgaacgtgtgctgattatcgtcccggaaaccttacagcatcagtggctggtagaaatgctgcgccgtttcaacctgcgctttgctctgtttgatgatgagcgttatgccgaagctcagcacgatgcttacaacccgttcgacaccgaacagctggtgatttgctcgctggattttgcccgtcgtagcaaacagcgtctggaacatctctgtgaagccgagtgggacctgctggtggtcgatgaagcgcatcacctggtgtggagcgaagatgcgccgagccgtgaatatcaggccattgaacaactggcagagcacgtgcccggcgttctgctgctgaccgcaaccccggaacaactggggatggaaagccacttcgcccgtctgcgtctgctggacccgaaccgtttccacgattttgcgcaattcgttgaagagcagaaaaattatcgtccggttgcggacgccgttgccatgctgctggctggtaacaaactcagcaatgacgaactgaacatgctcggtgagatgatcggcgagcaggatatcgagccgctgttgcaagcagcaaacagcgacagcgaagatgcccagagcgcccgtcaggaactggtttcgatgctgatggatcgccacggtaccagccgcgtgctgttccgtaacacccgtaacggtgtgaaaggcttcccgaaacgcgagctgcacactattaagctgccactgccgacgcagtatcagaccgctattaaagtctccggcattatgggcgcacgtaaaagtgcggaagatcgcgctcgcgatatgctctatccggagcgtatttatcaggaatttgaaggcgataacgccacctggtggaacttcgatccgcgcgttgaatggctgatgggctacctgaccagccatcgctctcagaaagtgctggtgatctgcgccaaagcggccactgcgctgcaactggagcaggtactgcgcgaacgtgaaggtattcgcgccgcggtgttccacgaaggcatgtcgattatcgaacgtgaccgcgctgccgcctggtttgccgaagaagacaccggcgcacaggtactgctgtgctcggaaatcggttctgaaggacgtaacttccagttcgccagccacatggtgatgtttgacctgccattcaacccggatctgctggagcagcgtattggtcgtctggatcgtatcggtcaggcgcacgatattcagatccatgtgccttatctggaaaaaacggctcagtcggtgctggtgcgctggtatcacgaaggtctggatgcattcgagcacacctgcccgaccggacgcactatctacgatagcgtgtacaacgatttgattaactatctggcctcgccggatgagaccgaaggctttgacgatctgatcaaaaactgccgcgagcagcatgaagcgctgaaagcacaactggaacagggccgtgaccgcctgctggaaatccattccaacggtggcgaaaaagcccaggcactggcagaaagcattgaagagcaggatgacgataccaacctgatcgccttcgccatgaacctgttcgatattatcggtatcaatcaggacgatcgcggcgacaacatgatcgtgctgacgccgtccgatcatatgctggtgccggacttccctggcctgtcggaagatggcatcaccatcaccttcgaccgtgaagtggcgctggcgcgtgaagatgcacagtttattacctgggagcatccgctgatccgcaacggtctggatctgatcctttctggcgataccggtagcagcacgatttcactgttgaaaaacaaagcgttgccggtaggtacgctgttggtggaactgatttatgtggttgaagcccaggctccgaagcagttgcagctcaaccgcttcctgccaccgacgccggtacgtatgctgctggataaaaacggcaacaacctggcggcgcaggtagagtttgaaacctttaaccgtcagcttaacgcggttaaccgtcacaccggcagcaagctggttaacgcggtgcagcaggatgttcacgctatccttcagctgggggaagcgcagatcgagaaatctgcccgtgcattgattgatgcagcgcgtaacgaagccgacgaaaaactgtctgccgagctgtctcgtctggaagctctgcgtgcagtgaacccgaacattcgtgacgacgaactgaccgccattgagagcaaccgtcagcaggtaatggaaagcctggatcaggcaggctggcgtctggatgccctgcgtttgatcgttgtaacgcatcagtaacggagccgaagatggggatggaaaactacaatccaccgcaggaaccctggttggttatcctgtatcaggatgaccatattatggtggtcaacaagccgagcggtttgttgtctgtgccgggtcgtctggaagagcacaaagacagcgtgatgacgcgcattcagcgtgattatccgcaggcagaatcggtgcatcgtctggatatggctaccagcggcgtgattgtagtggcgctgaccaaagccgcggagcgggagttaaaacgccagttccgcgagcgcgagccgaaaaaacagtatgtggcccgcgtctgggggcatccatcccctgcggaaggtctggtggatctgccgctgatttgcgactggccaaaccgcccgaaacagaaagtctgttacgaaacaggtaaacctgcgcagacggagtatgaagtggtggaatatgcggcggataacacggcaagagtggtgttaaaaccgattaccgggcgttcgcatcagctgcgtgtgcatatgctggcgctgggtcatccgattctcggcgatcgtttttatgcatcaccagaagcgagagcaatggcaccgcgtttgttgctacatgcagagatgctgacgattacccatccggcgtatggcaatagtatgacatttaaagcaccagcggatttttaatagtcacgctggcgaagttcggtaggccggagaaggcgttcacgccgcatccggcaattttgcgccgattgcctgatgcgacgcgggccgcgtcttatcaggcctacacgttgaaacttatttaaaccctttctgctgctttatcagctcataggcctgctgaatttcctgcgctttctgcttcgccatctccatcatctctggcggcaaacctttcgccaccaacttatcgggatggtgttcactcatcagcttacggtaggcacgtttgatggtggtcgcatcatccgtcggcttcacgcccagcacattacaggcatcttccagcgtcgggccacgctgcgcttgctgccagttaccaccgccagattgctgctgataaccgccgccaaactgtgcaccgccctgcatcatgcgcaaaaactggtcaaactgagcgcgggagatccctaattcttcagcaatgacatacagcaccgcccgttcattcgggtgcagtgaaccatcagcaaacgccgcctgaatctggatctccagaaacatacgaattaagtcaaaacgaccaaagcagacactgcgaaactggcgcatcttttcgcgcagcgggtaattgtctgattttcccacccggaacgcattttgcgccgcagtacgggaagcgccatgaaggttcattcggtccatcaactggctggcgatatgaatatcagcttccgtgacgcgacctttggatttggttaaatgccccatcacttcaaaagtggtggcaaaaaacagcgcctgacgctcacgctggttggcgaaccacgccattttacggctacgggctttatcaaacatatggccaattaacaggcccaatactacgccccaaaagccgccgcccattattaaggccacggtcacgccaatgatttttccccaatactgcatatattccccaaatcgacacacggatatcagggctatctcccacaatataaaggcgcttttacccatttctggctgcggtctattgtgagacatcgcctataatttgcattatcatacctgtcattcaatgccgtgcctaacaccacagacgctattcggacaggattaacactagcgtagagatgacgagtacgttagtctctgaccgtttgtcacgcgcaacgttaccgatgatggaacaataaaatcaacgtatgaaaaaacgtatccccactctcctggccaccatgattgccaccgccctttatagtcaacagggactggcagccgacctcgcctcacagtgcatgttgggcgtgccaagctatgaccgtcctctggtacagggcgataccaatgacttacccgtgactatcaatgctgaccacgcgaaaggggactacccggatgacgccgtgtttactggcagcgtggatatcatgcagggtaacagccgtctgcaggccgacgaagtgcagctccatcaaaaagaggcaccaggacaaccggagccggtacgtaccgttgatgcgctcggtaatgtccattacgacgataaccaggtgatcctcaaagggccgaaaggctgggcgaatctgaacaccaaagataccaacgtctgggagggtgattaccagatggtgggtcgccagggccgcggtaaagcggacctgatgaaacaacgtggcgaaaaccgctataccattctggataacggtagctttacctcctgtctgccgggttctgacacctggagcgtggtaggtagcgaaattattcatgaccgcgaagaacaagttgcggagatctggaacgcccgctttaaggtgggtccggtaccgatcttttatagcccctatttgcagttgccggtgggtgacaaacgtcgctctggtttcttgatcccgaacgccaagtacaccaccaccaactactttgagttctacctgccatattactggaacatcgcgccaaatatggatgccaccatcacgccgcattatatgcatcgtcgtggcaatatcatgtgggagaacgaattccgctacctctcccaggcgggcgctggcttgatggaactggactatctgccttcagataaagtctataaagatgaacacccgaacgatgacagttcacgtcgttggttattctactggaaccactccggggtcatggatcaggtgtggcgtttcaacgtcgactacaccaaggtcagcgatcctagctacttcaatgatttcgataacaagtacggttccagtaccgacggctacgcaacgcaaaaattcagcgttggctatgcggtgcaaaacttcaatgccaccgtttcaaccaagcagttccaggtcttcagcgagcagaacaccagtagctactcggcagaaccgcagttagacgttaactactatcaaaacgatgtcggtcctttcgatacgcgaatttacggccaggcggtgcactttgttaacaccagagatgacatgccagaggcgactcgtgttcacctggaaccgaccatcaatctgccgctctctaataactggggcagcatcaatactgaagcgaagttgctggcaacccattatcagcaaaccaatcttgactggtataactccagaaacacgaccaggctggcagagtccgctaaccgtgtaatgccgcagttcaaggtagacggtagaatggtcttcgagcgtgatatggaaatgctggcgccgggctatacccagacactggaaccacgcgcgcagtatctgtatgtgccatatcgcgatcagagcaaaatctataactacgactcgtcgctgctgcaatctgactactccggcctgttccgggaccggacttacggcggtcttgaccgtattgcctccgctaaccaggtgacgaccggtgtcacatctcgcatatatgatgatgctgccgttgaacgttttaatatttccgttggtcaaatctactatttcacggagtctcgcactggcgatgacaacataacatgggagaatgacgacaaaacgggctcactggtatgggcaggcgatacttactggcgcatctctgatcgttggggattgcgtggcgggattcagtacgatacacgtctggataacgtagcgaccagtaactccagcattgaataccgtcgggatgaagaccgtctggtacagctgaattaccgttacgccagcccggaatatattcaggcaacgctgcctaagtactattccactgctgagcaatataagaatggtatttcgcaggtaggtgccgtcgccagctggccaattgccgatcgttggtccattgttggggcctactactacgacaccaatgcgaacaagcaagccgactctatgttaggtgtgcaatacagctcctgctgctatgcgattcgcgtcggttacgagcggaagctgaacggttgggataacgataaacaacatgcggtatatgacaacgcaatcggctttaacatcgaacttcgcggcctgagctccaactacggtctgggtacgcaagagatgctgcgttcgaacattctgccgtatcaaaacactttgtgatttgttgatttaccacgtaatccgcagtgcggttaattgaaatggaaaaagtatgaagaactggaaaacgctgcttctcggtatcgccatgatcgcgaataccagtttcgctgccccccaggtagtcgataaagtcgcagccgtcgtcaataacggcgtcgtgctggaaagcgacgttgatggattaatgcagtcggtaaaactgaacgctgctcaggcaaggcagcaacttcctgatgacgcgacgctgcgccaccaaatcatggaacgtttgatcatggatcaaatcatcctgcagatggggcagaaaatgggagtgaaaatctccgatgagcagctggatcaggcgattgctaacatcgcgaaacagaacaacatgacgctggatcagatgcgcagccgtctggcttacgatggtctgaactacaacacctatcgtaaccagatccgcaaagagatgattatctctgaagtgcgtaacaacgaggtgcgtcgtcgcatcaccatcctgccgcaggaagtcgaatccctggcgcagcaagtgggtaaccaaaacgacgccagcactgagctgaacctgagccacatcctgatcccactgccggaaaacccgacctctgatcaggtgaacgaagcggaaagccaggcgcgcgcgattgtcgatcaggcgcgtaacggcgctgatttcggtaagctggcgattgctcattctgccgaccagcaggcgctgaacggcggacagatgggctggggccgtattcaggagttgccggggatcttcgcccaggcattaagcaccgcgaagaaaggcgacattgttggcccgattcgttccggcgttggcttccatattctgaaagttaacgacctgcgcggcgaaagcaaaaatatctcggtgaccgaagttcatgctcgccatattctgctgaaaccgtcgccgatcatgactgacgaacaggcccgcgtgaaactggaacagattgctgccgatatcaagagtggtaaaacgacttttgctgccgcagcgaaagagttctctcaggatccaggctctgctaaccagggcggtgatctcggctgggctacaccagatattttcgatccggccttccgtgacgccctgacccgcctgaacaaaggtcaaatgagtgcaccggttcactcttcattcggctggcatttaatcgaactgctggatacccgtaatgtcgataaaaccgacgcggcacagaaagatcgtgcataccgcatgctgatgaaccgtaagttctcggaagaagcagcaagctggatgcaggaacaacgtgccagcgcctacgttaaaatcctgagcaactaatggttaaaacccaacgtgttgtgatcactcccggcgagcccgccgggattggcccggacttaattgtccagcttgcacagcgtgagtggccagtcgaactggttgtttgtgccgatgccactctccttaccgaccgggcagcgatgctcggtttgccgctcaccctccgtccttattcccccaactcccctgcacaaccgcaaactgcgggcacattaacgctacttcctgtcgcgctacgtgaatctgtcactgcggggcagttagcggttgaaaatgggcattatgtggtggaaacgctggcgcgagcgtgtgatggctgtctgaacggtgaatttgctgcgctgatcacaggccccgtgcataaaggcgtcattaacgacgcaggcattccgtttaccggtcataccgagtttttcgaagagcgttcgcaggcgaaaaaagtggtgatgatgctggcaaccgaagaacttcgcgtggcgctggcaacgacgcatttaccgctgcgcgatatcgcagatgctatcacccctgcgcttttgcacgaagtgattgctattttgcatcacgatttgcgcaccaaatttggtattgccgaaccgcgcattctggtctgcgggctgaatccacacgcgggcgaaggcggtcatatgggtacggaagagatagacaccattattccggtgctcgacaagctgcgggcgcaggggatgaaactcaacgggccgctgcctgccgataccctgtttcagccgaaatatcttgataacgccgacgcggtgctggcgatgtaccacgatcagggtcttcccgtgctaaaataccagggcttcgggcgcggtgtgaacattacgctgggcctgccctttattcgcacatcagtggaccacggtaccgcgcttgaactggcgggacgtggtaaagccgatgtcggcagttttattacggcgcttaatctcgccatcaaaatgattgttaacacccaatgaataatcgagtccaccagggccacttagcccgtaaacgcttcgggcaaaactttctcaacgatcagttcgtgatcgacagcattgtttctgccattaacccgcagaagggccaggcgatggtcgaaatcggtcccggtctggcggcattgaccgaaccggtcggcgaacgtctggaccagctgacggtcatcgaacttgaccgcgatctggcggcacgtctgcaaacgcatccattcttaggcccgaaactgacgatttatcagcaggatgcgatgacctttaactttggcgaactggccgcgaaaatgggccagccgctgcgtgttttcggcaacctgccttataacatctccacgccgttgatgttccatctgtttagctatactgatgccattgccgacatgcactttatgttgcaaaaagaagtggtgaatcgtctggttgcaggaccgaacagcaaggcgtatggtcgattaagcgtcatggcgcaatactattgcaacgtgatcccggtgctggaagtaccgccgtcagcctttacaccaccacccaaagtggattccgccgtcgtgcgcctggttcctcatgcaacgatgcctcacccggttaaagatgttcgcgtgttgagccgcatcaccaccgaagcctttaaccagcgtcgtaaaaccattcgtaacagcctcggcaacctgtttagcgtcgaggtgttaacgggaatggggatcgacccggcgatgcgagcggaaaatatctctgtcgcgcaatattgccagatggcgaactatctggcggagaacgcgcctttgcaggagagttaacgatgatcaattcgccccgagtgtgtattcaggttcaaagcgtctacattgaggcacaatcttcacctgataatgaacgttacgtttttgcttataccgtaaccatacgcaatctggggcgagcgccagtgcagttgttggggcgttactggctgatcaccaatggcaatggccgtgaaaccgaagtccagggcgaaggagtggttggcgtccagccacttatcgcgcctggcgaagagtaccagtacaccagcggtgcaatcattgaaaccccgctgggcaccatgcagggtcactacgaaatgatcgatgaaaatggcgtccctttcagcatcgacattcccgtattccgactcgccgttcccacactcattcattaaaagaatatggcgacataccttattggcgacgttcatggttgttacgatgaactgatcgcattgctgcataaagtagaatttacccctgggaaagataccctctggctgacgggcgatctggtcgcgcgcggcccgggttcgctggatgttctgcgctatgtgaaatccttaggcgacagcgtacgtctggtgctgggtaatcacgatctgcatctgctggcggtatttgccgggatcagccgcaataaaccgaaagatcgcctgacaccgctgctggaagcgccggatgccgacgagctgcttaactggctgcgtcgccagcctttgctgcaaatcgacgaagagaaaaagttggtgatggcccacgccgggatcacgccgcagtgggatctgcagaccgccaaagagtgcgcgcgcgatgtagaagcggtgctgtcgagtgactcctatcccttctttcttgatgccatgtacggcgatatgccaaataactggtcaccggaattgcgggggctgggaagactgcgttttatcaccaacgcctttacccgtatgcgtttttgcttcccgaacggtcaactggatatgtacagcaaagaatcgccggaagaggcccctgccccactgaaaccgtggtttgcgattcctggccccgtcgctgaagagtacaacatcgcctttggtcactgggcatcgctggaaggcaaaggtacgccggaaggtatttacgcgctggataccggctgctgctggggtggtacattaacctgcctgcgctgggaagataaacagtattttgtccagccgtcgaaccggcataaggatttgagtgagggagaggcggtagcgtcttaaatcccgtcgagcataaaatctaatgctcctttaatcaacgttcggtgcgcgctggcatcgcaaaatttcgttcccagcgcgttaactggaacagttgcagtctcatgcgtcatgagcacatattctttgccgtctaccagtaaaaggattgggttaagccgttctggtgggcgaatacggctaaatcgttcaataggtgttaatggaataacgatacggcgattaatctcaccaataatgtcgctggtaacatcaataacaaagggaaacgcggcgttcctgccgcgactgcggtataccgtaaattgcatcgctagaagctccggtactcatcagagaaacatccggtttcatcagccaattgatttaacgcagcgatagcttctgtgttctcttcacgccaacgtgttgctgcatgttttttaagttcagcattgagcgcaaccgtaagggtggcgctcatatttaagcctgcatcacgagcgcgattgactaactcacggtcgacggtgacggtcacactttgtgtggtacgttttgcagtcatgatctcgtgctcctgtacaatttatacgtctagtatacacggatatctgcacgtatcagtgatgccggaattctaatatacgaaattaccgccgctccagaatctcaaagcaatagctatgagagttctgcgcatcagcgtcgtggaattcgctgaataccgattcccagtcatccggctcgtaatccgggaaatgggtgtcgccttccacttccgcgtcgatatgcgtcagatacagtttttgcgctttcggcaggaactgctcataaacgcgaccgccgccaatcaccatgatttctggtacgtcaccacacgccgcaatggcttcatccaccgacttcacccacgttacgcgatcgtccgtacccggttgactgctgagaataatatttttgcgtcctggcaacggacgaccgatggattcccaggtatggcggcccataatcacgggtttatttaaagtgttgcgtttaaaccaggcgagatcggcaggcaggttccacggcatggcgttttccatgccgataacgcgatctaccgctaacgccgcaatcagactgatcattgagatttcccgataaaaaaaattgtcgccactatacgtaaagcgtaaaccgtcgtcgactggtgcgaggatgatgttgaggaaaattttatattctgctggcgagtccacgctctctccctggactcgccgcattacaatgaaacaaaaacaaacagttagctgtaaagcgtgatttacgtcactctttattaggatgagggcttcgtttccggttcatccgccatattgccagtatgtttcccttcttcggttccctgccagccatgtcgttgaattaatgacagatgttcacggtcttcggtaatgatctcacttaacatcgcgctggtgcgtttatagaccgccgcacgggctttggtgtcgttctcaaccattgccatctcttccaccatctgaatattaaagcggcggaacacatcggcgcgttctcgcgcttcatacggccccagacctaaactttccagtgccagacgcccggttttcagcgcaccttcgaaggtttcacgctccggcttttcaacgcctgcctgacgcaaacgaatgtagtggtcgacatcgcgggcgcgggcaataatctgcaaatgtgggaaatgttctttcaccatctccgtcagttgcaggttggtttgcggatcgtcgatggcgttaatcagcacttccgctttcgccgctccggcagattccagtaaatccatccgcgtggcatcgccataaaacactttcataccgaatttacgcagcgtttcgatatggtccgggtcgtgatcgagcaccaccattttcaccccgctggagagcagtaaacgtccggttatctgcccaaaacgcccgaatccggcaatgattacccgcggctgttcttcgtcgatctcatcggcttcacgcgcctcttcagtagaagattgctcaaggcgattgaggatcaccagcagaatcggcgttgccgccatcgacagtgccaccgccagggtcagcgatttcgcccactctggctccagcacattcgccatctgcgccgcaccaaatactacaaaggcaaactcactgccctgtcctaacagcaccgcaaaccagcgacgctgtttatttggcacctgcaacggtcgggcaatcagccacagcatggcgattttgatgatgaggaagccgagcagcaaaataacaatgcgcaacggattttcaagcagcgtgccaaagtctatcgacatgccaacgccgatgaaaaacagccccagcagcaaacctttaaatggttcgatatcgctttccagcgcatgacggtattccgagcttgccagcagtacgcccgccagaaacgcgcccatcgccatcgacaagccgacctcttccagcagcaaaccaaagccaaacacgaggaataacgccacggcactaaacacttcccgcaagccagagcgggctacaaaacgcagcgccggacgcgtgacatagcgccccagcaataccaccagcaccagcgcacccgccacttttaacgccgagagagcaaatgcgcccatcgtcgtcgaggcattgctcgccgccagtagcgggatcatcgccaccagcgggatcgccgcgatatcctggaacagcagcaccgcaaaggcactgcggcccatttgcgtcaccatcagattgcgttcattcatcgcctgcatggcaattgccgtagaggagagcgccagcgtcatgccgatcaattccgctacctgccagcgcagcccaagtaacatgcagaacagccccagcaggccgccgcaaatcaccatctgcaatgcgccaccgccgaacactgccgcacgcagcttccacagcctttgtggatcgagttcgaggccgataataaacagcatcagcaccacgccaatctcggcaaagtgcagaatagattcggcatcggtcaccagtcgcagcccccacgggccaataatgcagcctgctatcaggtagccaagtaccgatcccagaccgaggcgtactgcaatgggtacaatcagcgccgccgaaccgagataaatcagcgcctgaatcaaggtatgactatccatgatgtgcctcctgccattccagcagacgttgcttatagtgacgcgcctgcccttcgagggtttcgtcgtcacaaataaaggtgcagtgcatggcaaacggtggcagccagttcagcccgcagtagattgccgtcgcctgtagcggctgcgacagcacatcaaaccccggatgcgtgccaatctcaaaatggctttccccaccgccggtcgtcaccgcccacagtaaatgtttgccatgcagcgccgtgccgccgtgaccgtaagcccagccgtgcgagaagactttatcgatccaaagtttgaggagcggaggaatgctgtaccactgcatcgggtgctgccagacgatcagatcggcacgagacagcgcctcctgttcggcggcaatgtcgatattgaagtcaggatagagttgataaagagagcgaatttcgacgccttccagcgtccttgcctgttcaagcatccgtttattcgcatgggaatgatgcggatatggatgcgcataaattataagaatcataggtagcccgcgtgattacgcctttgttttcccacaaagtgtagtcatatattcacgcagcttatagtcaataatattgattcagaaaagagagaaatctgaacaaattaccccattctctgcccgcggatcgtcatattgctggtctgcgccagtgacatccctcgagtctccggggcaaacgctacggaaatcaacaagccaaatagcgagatacccgcccccattagcatcgtgttactgataccgtaattattgataaagatcggcagtgcccaggtcgatacaatagtgccaatacggcttaaggacataatcacgcccacggcagaggcgcggatatccgtcgggaagagttcattaggataaagccactgcaaattacccggcccaccggagaaaaaggcatacaccgcaaacgccattaccaccagccagatccccatatccgggatcagccccaaaaccgccagcgccagcgtcatcatggcaaagctgccaatcaacaatggacgccgtccggcagtgtttagccacagcatcggcggaatacagccgagcataaagaacaggctaatcaccacgttccccagcgccgcgtttttgccaacccccaatcccaacaaaccaacgatttgcgggccaaaggtgtaaatggcgaacattgggatcacctggcaggtccagatggcggcaacaaacagaacaaaaggaaaatggcggcgattaaacagatcgcgaaaacgggtttgctgcggctgctcttcatcgaaagccaccggttcgccaaacagtttgatcatcatctcttcgcactcttttactcgccctttgcgtaacaaccagcggggagattcaggcagttcgaatcgaccaatcaaaatcaacaaacaggggatcgctgcgctacccagcatccagcgccaaccaccttccacatcataaagccagtaaccgaccagatcggcgcaggtcgcgccgacataccacatcgcggcaataaagctgatggaaaacgcccgctgacgggtactggagaactcagtgatcatcgaagtggcgatgggataatctgcaccgatgacaatgccgatgagtacccgcatcactaacagttcgacgggggatgagacaaacatcgtcgccaccgatatcacgccgatggcgatgatatcgatgaggaacattttgcgccgtccgactttatcggagatatagccaaacagcgatgtgccaacgaacagcccggcgagcgttcccgcgcccagcaagccaatccagtcagcgtccagtttcagcgccggagtcagttgctccagcgccacgccaatcattaccagtacataaccatccagaaacggaccaccgcttccccacagcaaaatgcggcggtgaatagaggagaatttaagatcatcaaagtttctggacggttgcatgggttattcctgtttttttgcaatgagagtcagtacggcattacgtatcaaaccaacatcagccgtaacggaactccacaccaaaggtgccgcgcgggtattcccattgttccagcgccgaccctagccccagaatgcggcaggtgccacactccagacatccggcgtaatcgaaacgcacgctgccgtcatcctgcttcttgtacagacctgcggggcacgctttcaccagcagctccagggcctgtttatctgcatcggccttcacaacaatgtgcggatgctcttcatcgacattgaatttattgacgcccagtttgacgtccacattgacgggagaagtcataaaacggtcactcctttcatgccatccttgatcagattgatgaagcccactttcttgccgtggcggaggattttcttgcgcatcagttccggcgcactgccgtcaatggtgaacaggtcacgcgccacgcccaccgccagttccgggtagccgctaaacatgcgtgggttatcaaggaacgccggtagtttctggtacatgcgcatatcgcgcagcgggccactctcaagatgttgacgatattccgcgagtttttgcttactgaaatcgtcgcttttcatcgctgaaagcacagtttttgctgctgcttccccggcggcaatcgccagatccataccgcgaatggtaaaaccgaggttcatacacattccggcagcatcaccggcaatcaatacgccgtcaccaaccagctccggcagcatgttgatacctgcttccggcactacatgagcggaatattccaccagcttgccgcccgcgatcagcggtgcaacggccggatgttgtttgaaatcttccagcatttgcggcaccgatttttttgcgtcatgcagatgatgcaaaccacaaaccagccccagcgacagggtattttcattggtataaaggaagccaccgcccatcaggccatcggtgggtgatcccgcaaacaggcaagccgcgccctgattaccctgcaactgaaaacggtcttcgataaccgacttcggtaactcgatcagttcctttacgccaaccgccacatccgtcggtttaacgcgttttgccatccccagcttttcggcaaggatggaattcaccccatcagcaaggatcaccgttttcgcttcaatcacatcgccatcggcttctacaccgacgactttgccatcgcgctgtacgaggttatcgacgcggatcccggtaattaactgcgcgcccgcttcttcggcctgctccatcagccaggcatcaaatttactgcgcaaaacggagtaagaacgctgggatggcgaggtttcgtcgccattgcagtagtccatagtcatcgctgacttctccgtcataaacgcaagtttttcatgggtgatcaggcgttctacgggggcggagtcagcgaaaccaggaataatgtgttccagactgtgggcatagagacgcccgccggtgacgttcttggcaccagcggaattgcctcgctcgataactaacacttgcgcaccttcgcgggcgagcaccagtgcggcaaccgaaccggcaagccctgcaccgacgatgatggcgtcaaagatatcttcggacataagagctccctgtcagcggcagggccaaaatgcagccctgccagagtggatcaacgcgctaaagctgcggtcagtgccggaaggatcttcacggcgtcgccaacaatgccgtaatccgcgtactggaagatcggcgcatttttatctttgttgatggcgaaaatggtttgcgacgcattagcgccaaccatgtgctggatctgcccggagatccccaccgccaggtacagttcaggtttcagcatcaggttggagataccgacatagcgttcgtgctccatccatttttcgttttccgccaccggacgagaacaggccaactccgcacctatcgccttgcaaagctgttctgccagcgcaatgttctctttgctgccaataccgcgaccaacgctgaccaccaggcgggctttgtcgagatcgacgctgttgctctgacgcgcctgggttgccgtgcgggtaatcgccacagccggagcctgccactccacggtgtgcgtttcgccagtgcgtgacgcgtctggctgagccacatcgaacgtgccgctgctgatggtcagaaccgcatacggcgtggcaatgcgttcttcgccaatcgccagaccgccgtaaaccatgtgtttcactgtcgctttaccgtcctgtacgctgacggtgctggcatcgttagacaccgccgcgttaaggcgataacccagttttgccgccagtaatttgccgcgacgggtgtttggcaacagcaccagaccgtctgcgccgtgctggcgaatagtgtcagctatgacaccggcgtaatcttcgatcatccgatcgttcggtttgccatttaatttccagacatgattagcgccgagctggattgcctgtgcgccgtcggcatcattgaggacgaacgtgttgatttgattagctaaagcctgcgcaccgttcatcagttccggcagacgagaaggggtatcgctgaatacccagacttgagaaaacgtgttcatagcatcccctgtaattaaatgactttgcgaagattttcagcaaatgcggcgatctgttcttcgccgtcgccttcaatcacgatgcgctgacgctcgcgctgtttcggcgcggcaacctgttgttctgaccaggctgcctctgcgttaaaaccgatatccgccgccgaccatacctggactggctttttcgccgcgccgagaatggctttcatcgaaggaatttgtggggagttgatatcagtggaaacagcaacaaccgcaggcagcggaatgcttaaggtttcggtttcatcttccagttcgcgctcaacggtgagggtatctgccgtcagggagataattttgctgacgccgttaactgccggaatattaaggatttcgcctaccagcaaaccaacctgctgggcataaaggtcggaagaaccatcgccacagaggatcaaatcaaagcctgctttctgagcggcagcagccagtacgctcgccgtttgttgcggcagtgcctgctcgaactggtcatcaatcaccacaatcagttcatccggaccgcgcgatagcacatctttacgccctttggcgttggtcagggctttaccgcccacacttaaggccgtcacctgcgcctctactgcctgttgctttagctggcaagccgcttcaatagcgttgagatcgtattggcttattttggcatcggctttgctgaagtctaacgaaccatcagcattattgaccgcaatatcctgttcatcaggcacgcacttatagcaagtaataatcttcattgcatctccagaaatcatgaaggaaacgtcgttcatatcggtggtgttaattacagatatcacgccctttaatttggaaataaaactttaatcaccaatattgaaaatgtcacacgcagataaatccaactttcaatattgttaagctcctcaccaatattgaaaacatggcgtagaaaaaagaaattttcaatattgttttatggatcaccaatattgaaagtcagatgctatttttttactcacaacagaacataacaaactgattaataatcaaaattaacgaaaaaatgccctctattcacccgaaacaaaaatgtgataacaatcacagaatgcagcttattgaatacccattatgagttagccattaacgcatccacgaggttaataataattatattaaatgttaacaaaaataaaacaaacgggaacgcaaaataaatattcgttttcacagtggaattaactcatgaagaatgaaaagagaaaaacgggaatagaaccgaaggttttctttccgccgttaataatcgtcggcatactttgttggcttacagtcagagatctggatgcggcgaatgtcgttattaatgctgtattcagttacgtcaccaatgtatggggatgggcatttgaatggtatatggtggtgatgcttttcggctggttctggctggtgtttggcccgtatgccaaaaagcgtttaggtaacgaaccaccagaatttagtaccgccagttggatctttatgatgttcgcctcctgtacgtctgctgccgtactgttctggggatcgattgagatctactactacatctccaccccgccgtttggcttagaaccgaactcaacaggcgcgaaagagttggggctggcttacagcttgttccactggggacctctgccgtgggccacttacagcttcctttcagtcgccttcgcttacttcttctttgtccgcaaaatggaagtgattcgccccagctccaccctggtgccgctggtaggtgaaaaacacgccaaagggttgttcggcactatcgtcgacaacttctatctcgtcgccttgatcttcgcgatgggtaccagtctgggccttgccacgccgctggtgaccgagtgtatgcaatggttgtttggcattccgcataccctgcaactggacgctatcatcattacctgctggattatcctcaacgccatttgcgtcgcttgcggtctgcaaaaaggggtacgtatcgccagtgacgtgcgtagttacctgagcttcctgatgctgggttgggtgttcatcgtcagcggtgccagcttcatcatgaactacttcaccgattcggtggggatgttactgatgtatctgccgcgcatgttgttctataccgatcccatcgctaaaggcggctttccgcagggctggaccgtgttctactgggcatggtgggtgatttacgctatccagatgagcatcttcctcgcccgcatctcccgtggtcgtaccgtgcgtgaactgtgcttcggcatggtgctggggctgacagcgtcaacctggatcctgtggactgtactcggtagtaacactctgctgttgatagataaaaacatcatcaacattccaaatctgatcgaacagtacggtgtggcgcgcgccatcatcgaaacctgggccgctctgccactcagcaccgccaccatgtggggcttcttcatcctctgctttattgccaccgttacgctggttaacgcctgctcttataccctggcgatgtccacttgccgcgaagtgcgtgacggcgaagaacccccgctgctagtgcgcattggttggtcagttctggttggcattatcggcattgttctgctggcgctcggcggcctgaaaccgattcaaaccgccattatcgccggaggatgcccgctgttcttcgtcaacatcatggtgacgctctcctttattaaagacgcgaaacagaactggaaagattaattaaccacccaaatatcaagaggttgaaagatggattttaatttaaatgatgagcaggaactgtttgtcgccggtatccgcgaactgatggccagcgaaaactgggaggcctattttgccgagtgcgaccgtgacagcgtctacccggaacgttttgtcaaagccctggcggatatgggtatcgactgtctgctgatcccggaagaacacggtggtctggacgcggggtttgttactctcgccgccgtgtggatggaactgggtcgtctgggagcgccaacttacgtgctgtatcagttaccgggcgggtttaacaccttcctgcgtgaaggtacgcaagagcagatcgacaagatcatggctttccgcggcaccggtaagcagatgtggaactcagcgattaccgaaccgggcgcaggctccgacgtgggtagcctgaaaacgacttatacccgtagaaatggtaagatttatcttaatggtagtaagtgttttattaccagtagcgcctacaccccgtacatcgtggtgatggcgcgcgacggggcttctccggacaaacctgtctacaccgaatggtttgttgatatgagcaaaccgggcatcaaagtgaccaaacttgaaaagctcggtctgcgtatggatagctgctgtgaaatcacttttgacgacgtggaactggacgagaaagacatgttcggtcgggaaggtaacggctttaaccgcgtcaaagaagagttcgaccatgaacgtttcctggtagccctgaccaactacggtacggcgatgtgcgcctttgaagatgcggcgcgctacgccaaccagcgcgtgcagtttggcgaggctattggtcgtttccagttgattcaggaaaaattcgcccacatggcgatcaaattaaactccatgaaaaacatgctgtatgaagcagcgtggaaagcagacaacggcaccatcacctctggcgatgcagcgatgtgcaaatacttctgcgccaatgcggcatttgaagttgtggatagcgcaatgcaggtgctgggcggtgtcgggattgcgggcaaccaccgcatcagccgcttctggcgtgacctgcgtgtagaccgcgtctccgggggatctgacgaaatgcagatcctgacgctgggtcgcgcggtgctgaagcaataccgctaagtccgtgcgctgcctgatgcgacgctgacgcgtcttatcaggccgacggtaggccggataaggcgtttacgccgcatccggcagtcatgcgctacataaatttttcaggagctaataatggatcatctacccatgccgaaattcggaccgctggccggattgcgcgttgtcttctccggtatcgaaatcgccggaccgtttgccggacaaatgttcgcagaatggggcgcggaagttatctggatcgagaacgtcgcctgggccgacaccattcgcgttcaaccgaactacccgcagctctcccgccgcaatttgcacgcgctgtcgttaaatattttcaaagatgaagggcgcgaagcgtttctgaaattaatggaaaccaccgatatcttcatcgaagccagtaaaggtccggcctttgcccgtcgtggcattaccgatgaagtcctgtggcagcacaacccaaaactggttatcgctcatctgtccggttttggtcagtacggcaccgaggagtacaccaatcttccggcctataacactatcgcccaggccttcagtggttacctgattcagaacggtgatgttgaccagccaatgcctgccttcccgtataccgccgattacttttctggcctgactgccaccacggcggcgctggcagcactgcataaagtgcgtgaaaccggcaaaggcgaaagcatcgacatcgccatgtatgaagtgatgctgcgtatgggccagtacttcatgatggattacttcaacggcggcgaaatgtgcccgcgcatgaccaaaggtaaagatccctactacgccggttgcggtctgtataaatgcgccgacggctacatcgtgatggaactggtgggcattactcaaattacagagtgctttaaagatattggcctcgcacacctgctcggtacgccggaaatcccggaaggcactcagcttatccaccgtatcgaatgcccttacggcccactggtagaagagaaactcgatgcctggctggcggcacataccatcgcagaagttaaagaacgctttgccgaactgaatatcgcctgtgccaaagtactgaccgtgccggaactggaaagcaatccacagtatgtggctcgcgaatcaatcactcagtggcaaacgatggatggtcgcacctgcaaagggccgaatatcatgccgaaattcaaaaataaccccggacaaatctggcgcggaatgccctcacatggcatggacacggctgccattttgaaaaatatcggctacagcgaaaacgacattcaggagttggtcagcaaaggtctggccaaagttgaggactaaacgcgtggcgtcagtcaacttgcctgactagcgcccgcccaataacaaacgaacaaaatggatagaggtgcaatggatatcattggcggacaacatctacgtcaaatgtgggacgatctggcggacgtttacggtcataaaacggcgctgatttgtgaatccagcagcggagtcgttaaccggtatagttatcttgagttaaatcaggagattaaccgcacggcaaacctgttttatacgctggggattcgcaaaggcgacaaggttgctctacatctcgacaactgcccggaatttatcttttgctggttcgggttggcaaaaattggcgcgattatggtgccgattaacgcccgcctgttgcgcgaagaaagcacgtggatcctgcaaaatagccaggcgtgcctgctggtgaccagtgcgcaattttatcctatgtatcaacagattcagcaggaagatgcctctcagttgcggcacatttgcctgacagatatggtacttcccgctgatgatggcgtgagttcgtttactcaactgaaaaatcaacaacctgccaccttgtgctatgcaccgccgctatcgactgacgatacggcggaaattctcttcacctccggcaccacctcccgaccgaaaggggtggtgataactcattacaacctgcgcttcgctggatattactccgcctggcagtgtgcactgcgtgacgatgacgtctacctgacggtaatgcctgcgtttcatatcgattgccagtgtactgcggcgatggcggcgttttctgccggggccacctttgtgctggtcgagaaatacagcgcccgcgccttctggggacaggtgcagaagtaccgcgccaccattaccgaatgtattccgatgatgattcgtacgttgatggtgcagccgctttcagcgaacgatcagcaacaccgcctgcgggaagtgatgttttatctcaacctgtcggagcaggaaaaagacgcgttttgtgaacgcttcagcgttcgcttgctgacgtcttatgggatgacggaaaccattgtgggcattatcggcgatcgccctggcgataaacggcgctggccgtcgattggtcgggcgggcttttgctacgaagcggagatccgcgacgatcacaatcgtcccctcccggctggtgagctcggtgaaatctgtattaaaggcgtaccagggaaaaccatcttcaaagagtattttctcaacccgaaagccactgcgaaagtgctggaagccgatggctggctacataccggcgataccggataccgcgacgaagagggctttttttatttcgtcgatcgccgctgcaatatgatcaaacgcggtggcgagaatgtctcctgcgtggagctcgaaaatatcatcgccacccatccaaaaattcaggatatcgtggttgtgggtattaaagattcgattcgcgatgaagccatcaaagcatttgtggtgctgaatgaaggtgaaacattgagcgaagaggaattcttctgcttctgtgaacagaatatggcgaaatttaaagtgccctcttatctggagatcagaaaagatctgccacgtaattgctcggggaaaataattagaaagaatctgaaataaatgaaacggcagggaactaccctgtcagctaataatcacgctctaaaacaatatgcattttttgcagggatgttgtcgtccctgaaaaagcaaaaatggagaaaaggaatgagtgaatcattacatctgacccgcaatggatcaattctggaaattacccttgatcgtccaaaagcgaatgctattgatgcaaaaaccagctttgaaatgggcgaagtatttctaaatttccgtgacgatccgcaattacgtgtcgccattattaccggtgccggagagaaattcttttccgcgggctgggatttaaaagcggcagcagaaggcgaagcaccggatgctgactttggcccgggaggttttgcgggattaaccgaaattttcaatctcgacaaaccggtcatcgccgctgtgaacggctatgcctttggcggcggctttgaactggcgctggcggcagattttattgtttgtgccgataacgccagcttcgccctaccggaagccaaactgggcatcgttcctgacagcggcggcgtgctgcgtctgccgaagatcctgccgcctgccatcgtcaatgaaatggtgatgaccggcagacgaatgggcgcagaagaggcgctgcgttggggggtagtcaaccgcgtggttagccaggcggaactgatggataacgcccgcgaactggcgcagcagctggttaacagcgctccgctggcgattgcggcgctgaaagagatctaccgcaccaccagtgaaatgccggtagaagaagcgtatcgctatattcgcagcggcgtgttgaaacactatccgtcggttctgcattcggaggatgccattgaagggccgctggcgtttgccgagaagcgcgatccagtgtggaaaggacgttaacaaccgtgagctattacgcctttgaggggttaattccggttgttcacccgacggcgtttgtccatcccagtgcagtattgattggcgatgtgattgtgggagccggtgtctacatcggcccactcgcctcactgcgtggtgactacgggcggttgatcgtgcaagcgggagccaatattcaggatggctgcattatgcatggctactgcggcactgacaccatcgttggggaaaacggtcatatcgggcacggagcgatcctgcatggttgtgtgattggtcgcgatgcactggtcgggatgaacagcgtgattatggatggcgcggtcattggcgaagagagcattgttgccgctatgagctttgtcaaagcgggctttcgcggcgagaaacgccagttgttgatgggtacgccagcccgcgctgtacgcagcgtgagtgacgacgagttacactggaaacggttgaataccaaagagtatcaggatcttgtcgggcgctgtcatgcagcgttacatgaaacgcagccactgaggcaaatggaggaaaatcgcccccgtttgcaggggacgacggatgtgacgccgaaacggtaacatcgtcggatgcggcataaacgccttatccgacctggctgtaaagcaaccgtaggccggataagatgcgccagcatcgcatccagcgaccaggtcgcacggtatcaacgaaatgacattaacgacgcatactctttgacaacatcatctgccacttctgctcgcggttaagttccgtgagcggaacggcaggaatacgcggcgtctttcttacgccgactaatttatcccggctgttattgcgcaggcgcgcgtaaatttgctcatcgatatcaaccacttttaccagtcgctggcactggcatccccgcccttccagcttattagggatcatcttaacttcgcagcttatttctgtgacttccgacagaatataagtcagggtattaaccgccttgctgtgttcaatatcgaaatgaatagagatctctcttgctatcacccaccggttttcagccatcatccattcggcgattaacaaatagagtggtttttcaacacatccttcacacatacgaactccagtttcacaaattaaaagactggctatgactcgttttgcagcaattaaacaaggccatattaaaattgtggatatatcgatagtatgcaacttcaccgtcgataagtgtgagctaaatcctgcttatgtcatcaaaaatatcgattccccaaaagatttacttaatgggcaaaaaaaacggtcctcatcagagaaccgtattagttattcgatcaaattagcggatgaaaaatatccgccatgacacgctattatttgatctgcgcgtgcatttcctgcaccgaaattactttttcggtcgcatcggcattcagcgccatcgcggtggcaaagccgccgttcagggtggtgtcgtaatgcactttatattgcagcgcactgcgacggatcacgcgggagtcttcaatcgcacgacgacctgaggtggtgttgatgatgtaggtatattcgccattcttaatacggtcctgaatgtgcggacggccttcatgcaccttgttcaccagacgcggattgatacccgcttcgcccagcacaatcgccgtgccgtgagtcgcatccagctcgaagccctgtttcagcagttttgccgccaggtccaccacgcgttctttatcgccttcgcgcacggaaagcagcgcacgaccgtgtttcttcatggtggagttgctgcccagctgcgctttggcaaacgcttcagcgaaggtgcggcccacgcccatgacttccccggtagagcgcatttctggccctaacagcgggtcaacgcccgggaatttattgaacggcagcaccacttctttcaccgagtagtacggcgggataacttctttggttacgccctgctcagccagcgatttgccagccatcacacgcgccgccacttttgccagcggtacgccggtggctttggagacaaacggaacggtacgcgccgcacgcgggttaacttcaatcaggtagacttcgttgtttttcaccgcaaactgcacgttcatcaggccgcgcacctgcaattcgaaggccagtttctgcacctgctggcgcatcacatcctgaatttcctgacttaaggtgtaggctggcagcgaacatgcggagtcaccggagtgcacgcccgcctgctcgatgtgctccatgatgccgccaatcagcaccatttcgccgtcgcagatggcatccacgtcaacttctactgcgtcatcaaggaagtggtccagcaacactggcgcatcgttagatacgctgaccgctgtctggaagtagcgacgcaggtcagcttcgtcatagacgatttccatcgcccgaccgccgagaacgtaagacggacgcaccaccagcgggtagccaatctctttcgctttctcaaccgccatttcgatggtggtaacggtggcgttcgccggttgtttcagtttcagacgctcaaccgcatgctggaagcgttcacggtcttccgcacggtcgatggcatccgggctggtaccgataaccggtacgccagcagcttccagcgcgcgcgccagtttcagcggggtctgaccgccgtactggacgataacgcctttcggcttctcaatacgcacaatttccagcacgtcttccagagttaccggctcgaagtagaggcggtcggaagtgtcgtaatcagtggagacggtttccgggttacagttaaccataatggtttcgtaaccgtcttcacgcagcgccagcgaggcgtgtacacagcagtagtcgaattcgataccctgaccgatacggttcgggccgccgccgaggaccatgattttgtcacggtcagatgggttggattcgcactcttcttcataagtggagtacatgtaagcggtgtcggtggcgaactctgccgcacaagtatccacgcgcttgtaaaccgggtgcagatcatactggtcgcgcaacttgcggatttccgcttcgcgcacgcccgccagtttagccagacgcgcatcggcaaagcctttgcgtttcaactggcgcaggaattcagcgtgcaggccagtgatgcccacttctgcgactttctcttccagacgcaccagctcttcaatctgtaccaggaaccagcggtcaatgttggtcaaattaaatacaccgtctacagacaggcccgcgcggaaggcatcagcgatataccagatacgctctgcgccagcatctttcagttcgcggcggattttagtcagcgcttccgggtcgtcgagactcactttcggatcgaagccagttgcgcccacttccaggccgcgcagcgctttttgtagggattcctgctgcgtgcgaccaatcgccatcacttcgccaaccgatttcatctgagtggtcagacggtcgttagcaccggcgaatttctcgaagttgaagcgaggaattttagtaaccacatagtcgatggacggctcgaaggaggccggagtacgcccaccggtgatgtcgttcatcagctcgtcgagggtgtaacccaccgccagtttcgccgccactttggcaatcgggaaaccagtggctttcgacgccagcgcagaggagcgagacacgcgtgggttcatttcgataacaatcaggcgaccgtttttcgggttcaccgcaaactggacgttggaaccaccggtttcaacgccgatttcacgcagtaccgccatcgaggcgttacgcatgatttgatattctttgtcggtcagcgtttgggctggcgcgacagtgatggagtcaccggtgtggatgcccatcgcatcaaagttttcgatagagcagacgatgatgcagttgtcgtttttatcacgcaccacttccatctcgtactctttccagccgatcagcgactcatcaatcagcagctctttagtcggagaaagatccagaccgcgggcgcaaatttcttcaaattcttcacggttataagcgataccgccaccgctaccgcccatggtaaaggatgggcgaataatgcacgggaagccaacttcagcggcaaccgccagcgcttcttccattgaatgagcgataccggaacgcgcagtttccagaccgattttcttcatcgctacgtcgaaacggcggcggtcttcggctttatcaatcgcatcggcagtggcaccaatcatggtgacgccgaactcttccagcacgccctgacgctcaagctccagcgcacagttcagcgccgtctgcccccccatggttggcagcaccgcgtccgggcgctctttttcaataatcttgcgtaccacttcccagtgaatcggctcgatgtaggttgcatcagccatttccgggtcggtcatgatagtcgctgggttggagttcacgagaatgacgcggtaaccctcttcacgcagggctttacacgcttgcgcgccagagtagtcaaactcacacgcctgaccgataacaatcgggcccgcacccagaatcaggatactttttatatctgtacgttttggcatggctcttttactcctgattacttagcggttttacggtactgctcaattaacgcgataaagtggtcaaacaacggcgcggcgtcgtgtggaccagggctggcttccgggtgtccctggaagctgaacgccggtttatcggtacgatgaatgccctgtaacgtaccgtcgaacagggatttatgtgtgacacgcaggtttgcaggtaatgttgcttcatccaccgcaaaaccgtggttctgggcggtgatcatcaccacatttttctcaacatctttaaccggatggttgccgccgtggtgaccaaatttcattttgatggtcttcgcaccgctcgccagcgccagcagctgatgaccgaggcagatgccgaataccggaatatcagtttcgaggaatttctggatagcggtaatggcgtaatcgcacggggccgggtcgccaggaccgttggagaggaagatgccgtctggattcattttcagcacatcttccgcagaagtttgcgccggaacgatggtcaggcgacagcctctatccaccagcatacgcaggatgttgcgcttggcaccgaaatcgtaggccacgacgtggtacggcagctcgtcttcttttttcgcttctggcaggccgccggtcagtgtccagctcccttgtgtccagctatagggttctgcggtggttacttcttttgccagatccatgccgttcagacctgggaacgcgcgggctttttctaacgccagcgccgcatccgggttgtcacccgcaataatgcagccattctgagcacctttctcacgcagtaaacgcgtcagcttacgggtatcgatatcggcaatcgccacgatgttatggcgcttcaggtaagaagagaggtcttcggtattacggaagttgctggcaatcagcggcaggtcgcgaatcaccagaccttgggcatgaacctgagaagattcttcatcggcgtcattagtgccgacattgccaatatggggataagtaagagtaacgatttgacgagaataggaaggatcagtgaggatttcttgataaccggtcattgaagtattgaaaacgacttccccaaccgccgaacctgttgcccctatggcccgaccgtgaaactgggttccgtcttccagaaccaatagcgctgacttaatcaaaacaccctccagagaatattcactcactttatttgcatattaattcacaatgatgacgtaaatcaatgcaaatctgcttaccgacgaatttctggcaaacggcggcattctggagatatgggagctaaaagtcaacttaatggcgggattttttatattattttgtggctcatgcatgttttacaggcattaagcgacaaaaagatcatataacatgttctggaaaacgcttgcgcagcaagaagattgcatgaaatcaaaatgagcagaaaaaagtggaccaaatggtcaaaatttacattaaaacaacaaaaacagaatacaaaacatgtaattttcagcatttgcattagatttaaaatcataacactaaaaataaaagggccaaaaatcaaagccctttatattcaatgaattaaatgtgttatttttgcatcaccataaatatcttgtggttacagattattgagatcaagcacatctcgcatatcaaaaagaccactttccttaccactcaaccacaaagccgatcttaccgcaccgttagcaaatgtcatgcggctggatgccttatgggtgatctccagacgctcgccaatatcggcaaacatcgcggtatgttcgccaacgatgtcacctgcacgcacggtggcaaaaccaatggtgccaggcacacgttcaccggtatggccttcacgactgtagaccgcgcaatctttcagatctttatccagagcgtgggcgatcgcctctcccattgccagtgcggtgcctgacggcgcatcaactttatgtctatgatgtgcttcaataatttcgatatcggtgtagtcccccatcactttggctgctttctccagcagtttaagcatgacgttaacgccaacgctaaaattggcggcaaagacaatcgcaatatcggcggcggcgtcacgaatcgcctgtttaccggcttcgtcaaaccccgtagtgccgatcaccatccctttgccatgctggcgacaaaaagcgagatggttcagcgtaccttccggacgggtaaaatcgataaacacatcaaaatcatcttttatcgcatcaaggctgctttgcacagtaacgcctgtttttcctgcacccgccagctcaccggcgtcgctgcccagtaaagaagatccttcgcgctccagcgccgcgcccagctgcacgccttctaatgccagcgccgcctgaatcaactggcggcccatacgccccccggctcccgcgatggcaacgcggatgtttgcatcatgcatagctattctcttttgttaatttgcatagaccgttttcagagtaaccagcgcatcgctacgccgccagccaaaaacgctgataattagaaattaatgataaacagggagggatatcagtgaaaggcatgagtcgatgaatgactgcatgccgataacatgtgacaggttacggcaccagagccagcacctcagctacccactgctggaagccttttacattcagatccaatgccacctgtacattggctggtttgcccaggcaaccgtcgatatcaactaccgtcgtgcctgaggtaaattcgccttgagtttctaccgcgacaaaacacggtttgagagtgaacaattccgggcgcaccagccaggcgatagcgcaaagatcgtgcatacgtagtccactttgcatactgccgctacggtagtggctaaacagggcgtgtagcatttttccggtgcgattcaactccggcaaagtagcgagatagtcaggggttaatattgcctgattggtgacatccagaccacacatgacgatttcgatgccgctacggaagacacaggctgccgcttctggatcggcagcgatattaaactcggcgtttggtgtgcagttgccgcgaccagcagaaccgcccatgatcaccagacggcgaatatacggcttacattccgggcattgtgaaagtaacagcgcaatattggttaacgggccgatggccaccagggtaacgggctctggcgcacgcatcagggcatcacgaattgccagaaacgccggtatacccagtggctgacggttgtgttcaacaaagtcatagccagccattcccgattcaccgtgtacagatgccgcatcgcgcggcgcacgaaccagtggtacggcagcgccctgggcaagcggaatatccacattccagaaatgcagcagttgcagggcgttgcgggtcgttttctctaccgaaacattacccgcgacagtggtcatcagttgcagatcgagttcgggggtaaaaatcgcggcggcaatggcaacggcatcgtcaatgccggggtctgtatcgaggaagataggtaaacgcatgttttctccataaaaaatgccggtaacaagaccggcattttcgcataacttaggctgctaatgacttaatcgacttcacgaatatcgactcgcagctctttcggcacttcgaaaacgatattttcttcgcggccttccagcggaatggcttcgccaccgccaagctgctgtaaacgtgcgactacgttctgtaccagaatatccggagctgatgcgccagcagtcacgccgacgcatttcgcctctttcacccactcttcctggatatctgtcgcatcgtcaatcaaaaacgcgcgtttgcccatacgctgggccagttccgccagacggttggagttggaagagtttttcgaaccaaccaccagtactacttccgcctgctctgccagggcgcgtaccgcttcctgacggttagtcgtggcgtagcagatgtcatctttgcgcggaccgacaattttcgggaagcgtttacgcagcgcgtcgatcacatcagacgtgtcatccaccgacagcgtggtttgggtcataaaggagagcttctcttcgtttttgaccgtcagtttccacacatcgtctggcgattcgaccagatacattcccccttccgggttgctgtactggcccatcgtcccttccacttccgggtgcccggcgtgaccgatgagaatagattcttcaccacgacggctggcgcgggcgacttccatatgcactttggtcaccagcggacaggtggcgtcaaataccgtcaaatcacggcttttcgcttcattacgtaccgcctgagaaacaccgtgtgcggagaaaatcaggatcgcgccgtccggtacttcgctaatctgctcaataaagatagccccacgctcgcgcaggctatcgaccacgtagcggttatgcaccacttcgtgacggacatatatcggtgcgccgtaaatggccagcgcgttttcaacaatgctgatagcgcggtctaccccggcacaaaaaccacgcgggttggccaacaggatctgcatgttacgcctccagtgccggatcgatttccagcacttcaatatcaaaatgaacggtctgcccggccagcggatggttgaaatcaacggtaatggagtcgccgttaatttcgcggatcacgccaggcatctcactgccatccattgcggtaaaaagcatgattgcgccaatttctggctcgcctgcatccataaattcacggcgggagaagtactgaatcaggtccggtgacggcacgccaaacgccgcatctggctccagcgagaaggtggttttatcgcccactttcagccccagcaggtgttgctccagcccttcagaaagagaagcatcacccaggcggaacagcgccggtttaccgttgttgcgggtagactcagcggtggtgccatcgtcgagttttagcgtgaagtgcaccaggacggcgctattgctctgtacagattcagacatgcaggtttgctcttatattttgaggatttttgccggatgcgacctacgatttcgcagcaatctgtaggccggataagatgcgtcagcatcgcatccggcagggtttattattgttttttcgctttagaaggtaaaaaaccttccagcacaatcagtgccgcaccgacacaaatggcagtatcggcaaggttgaaggtggcgaagtgccagtcgccgacatagaagtcgatcatatcgacaacgaagccgtgccacaggcggtcgaacaggttgcccagtgcgccgccaataatcagcgcgtaagcgatattgtttagcttctgcgtggccttcgagcgatacatcatcactaccaggatcacgctaataccaatcgcaataccggcaaagaaccaacgctgccagccgccgctatcggcaaggaaactaaacgccgcgccatagttacgcgcataatgcagattaagcgacgggaacagcgggaccgtatcccccagagcaaagttctggaggatcaggtatttgctgcccagatcgataatcagcacgactaccaccagccacagccagcgtagccctgttgaacagatcgattgactcatcaggcaaacttacgtttttcaccgtcaccggcgacgttgctgacacagcggccgcagatttctgcgtgttccgccaccttgccgacatcctgggtgtagtgccagcagcgaggacacttctcaccttcggctttactcaacgcgactttcagccctttgaggacttcgctctgctgggcatcagcaggtgcgtcgttatagtctgcaacggtagcgccggaggtcaacaggacaaatcgtaattcatcgcccagcgcggtcagtttcgccgccagttccggttctgcatacaaggttactgccgcttccagcgagccgcccacgttcttatcggcacgcgcttgctcaatgactttgttcacttcgccacgcactttcaacagctcgtcccagaacgcatcgttcattgcttcactgtctgccagaccaaacaggccttcgtaccactcgccggtgaagacgtatttttcacgttcgcccggcaggtaaccccacacttcatcagcggtgaaggagaggattggtgccatccagcgaaccagcgcttctgcgatgtgatacagcgcagtctggcagctacgacgcgccacgctgtccgctttggcggtatactgacggtctttgatgatgtcgaggtagaaggaacccatctcaacggagcagaagcgcatcagacgctgtaccacttcgtggaaatcgtatgcttcgtacgccttgaggatgtcttcctgtgccgctttcgcacaacctacggcccagcgatccagtaccaccatctcttccggtttcaccatatcttttgccggatcaaaaccgttcaggtttgccagcaggaagcgcgcggtgttacggatacgacgatagctgtcggcagcacgtttcaggatctcgtcagaaacggccatttcgccagtgtagtcggttgatgccacccacagacgcagaatatccgcacccagtttattcatcacatcctgcggcgaaacggtgttaccgatggatttagacatcttgcgaccctgaccatccacggtaaagccgtgagtcagtacctgacgatatggcgctttgcccttcatcgcggtagagatcatcagggaagacatgaaccagccacggtgttggtcagaaccttccagatacatgtccgctgcgtgaccggcaaattccggacgcacatcaacaacggaagagtgggtagatccggagtcaaaccatacatccagcgtatccggtactttcacatactggtcagcttcgtcgccgaggatctctttcgcatcgagatcccaccacgcctgaatgccgtcaacttcaacgcgttttgccacttcttccatcagttcgagagtacgcggatgcagttcttctgtgtctttgtgcacgaacagtgacatcggcacgccccaggtacgctgacgagagatacaccagtcaggacggttagcaaccatcgactcgatacgcgcctggccccagtcagggatccactgcacgcctttgatctctttcagtgactgcgcacgcagacctttctgatccatgctgacgaaccactgcggcgtcgcgcggaagatgatcggcgttttatgacgccagcagcacggatagctgtgttgcattttctcaacgtgcaacagtgcgcctttttcctgcaacaacgcaatgacaatatcgttcgctttgaagacgttaacgccatccagagtcgggtaagtacccggcagataagtgccgtccgggccaaccgggttagcggtttccagaccatatttttgaccgatcacatagtcgtccggaccgtggcctggcgcggtatgaacggcaccggtaccggcatccagcgtaacgtggtcgccgagaattgccggaacatcgaagtccataaacggatgggtaaagcgcaacagttccagctcggcacctttcaccgtgccaagaatggtgtaatcgctaacgccgatacgctgcattacgctttcaaccagatctttcgcgaggatcacggcctgaccgtcgatttgcaccagcgcataatcaaaatcaggtgcaatggagattgcgcggttagcaggcagcgtccacggcgtggtggtccagataaccagcgaaattgggccgttaacattgcttacgccaaatttcgttttcagcgcatcctgatcgaccgcctggaaagcgacgtcgatggacggagaagttttgtcgtaatactcaacttccgcttctgccagtgcagaacggcagtcaacgcaccagtgcaccggcttcgcgcctttgtgcaggtgaccgttgccgatgattttgcccagcgcgcggatgatgttggcttcagttttgaagtccatggtcaggtacgggtgcgaccagtcgcccagcacgcccagacggataaagtctttgcgctgaccgtcaacctgggtcgcagcgtattcgcggcacttggcgcggaactcagcggcggtgaatttctcccccggcttaccgtattcttgctctactttcagttcgattggcagaccatgacagtcccagccaggcacatacggcgagtcatatccagaaagccctttggacttaatgataatgtctttcagaatcttgttaaccgagtgaccaatatgaatgctgccattcgcataaggagggccatcatgcagaatgaaggtttttttgccttttttagccgcacggatgatgccgtacagatcatcatcagtccaacgcgccagcattcccggttcgcgcttggcgagatcgccacgcatcgggaaccctgtttccggcaaattcagggttgatttatagtcactcatcagattctcggttccgtatttcggtttgattacataacaggcttaagccggttttgttagcccaaaaaattcgcgggcggttaattcatcacgcgcaatctgcgctttcagttcgtccagcgatgcaaatcgctgctcattgcgtatttttttacgcagcactacttgtatatggcgaccataaaggtccattgcaacatctaacaaatgcacttccagttgctggcgaataccggcaaccgttgggcgtgttccgatgtttgcaacgccgggtaacggcttttcgccaaggcccaacacttctaccgcataaacccctttcaccggggaaacctgacggcgtagcggtacattcgccgtcgggaaacctatagtgcgccctaattcatcaccgtggactacacgcccggagatagcaaacgggtgccccagtaaactttctgccagagccagattgtcatccgcaagcgcctgacgcacggcggtgctgctgatacgcacaccaccttcgcaaaaagtttgcgtgctggtgatatcgaagccgtattccatgcccgctttctgtaataacaagaaatcgccttcacgaccagcgccaaagcggaaatcgtcacctacggcaagaaattttacccgcaagtgcttcaccagaagatcactgatgaagttttgcgcggttaacgccgcaaaacgcctgtcaaaacgcacgcacagcacgtaatcaacgccacactctgcaagataacgcagtttttcccgcagccgggtgagccgtgccggggctttatcagtagcaaacagttccagtggttgaggttcaaaaagcatcaccatcaccggtaagttgcgcttgcgcccttcttcctgcaagccctgtaacagcgcgcgatgaccgcgatgcacgccgtcgaaattaccaatagtcagcacacacccttcttgcggggcctggctgagattatgtatgccgcgtatcagcttcatgtctggctcaaaacagtgaaaatcgtccgagtataccttgtacagcggtcaaggttaaccggcgattgagtaccgaaatcagaaagaagtggcttttcattgctatggcgcaaatcatgggaagaaactgaccgcctgctgcaatttttctcgcggaaaagctgtattcacaccccgcaagctggtagaatcctgcgccatcactacgtaacgagtgccggcacattaacggcgcttatttgcacaaatccattgacaaaagaaggctaaaagggcatattcctcggcctttgaattgtccatatagaacacatttgggagttggaccttggctaatatcaaatcagctaagaagcgcgccattcagtctgaaaaggctcgtaagcacaacgcaagccgtcgctctatgatgcgtactttcatcaagaaagtatacgcagctatcgaagctggcgacaaagctgctgcacagaaagcatttaacgaaatgcaaccaatcgtggaccgtcaggctgctaaaggtctgatccacaaaaacaaagctgcacgtcataaggctaacctgactgcacagatcaacaaactggcttaattgcctgttgttgtcagctttgtaaaaaaacccgctctggcgggtttttttatatccatctgcaggccaaaattcggcctgcaaagtacaaatgtttattttgaagctggagtaaacagcgcagaatagtctgtattgcagatacgctgtactgcagggtgctgaatcatcctttcggcaaaaatcgcgtggtactcttccatcacgttctcaacacggcctatctccacaaccgagtcatcgttatagaaatcattagcgtaaagcgaaggtgcaacgaaaatagcgttatgcgtcgccccaaaggctttcatcaacgcagcatcatcaaactcacccaaaatttcgacgttcaagccctgggagttaaaccagtttaatagtttacgccccaacattgagcgacgccccggaataagtaaacgacgctcttcaagacaggcaggaaacggcttttctggtagtgggttagtgcaccagaaactgacaccacattcgccaattttcatggaaaacagcccttcctgctgagtggaatcgatcggacagtcagagatgatcatatccagtttatgctgactcaactgctctaaaagcatctcgtgcgtcgattcgaaacagcgtagatggatctgctcgtcttccacaactgcggcatccagaacactgctgaccagacgtttggaaagtgcatctgccacaccaacatcaaacaataagttggactctttgcgatagttgacgatatccagcatttcctggcttaaggtgaacattttatcggcatagcgatagaccagttcccccagttcgctgggttccagaccacgtcctttacgcttaaatagtttcccttgcaggcgctcttccagcgcccggatctgcccggtaatggtttgtggtgttaaataaagcgcctccgctgcgccaaccacagaaccttctttgtagacatgccagaagtaatacaagtggttgtaattgatatgagacatgctcatttctctccctgataacaatgaaaagggagccgtttatggctccccagtacatcgtcctgtcaaactgatggacgtaaacgaacgcgtaaccagctatatccaattaccgccgaagaaattgaaccgacaaggatacctaattttgcccagttaatcagttctggatctacgctaccaaatgccaggctggcaataaagatagacatagtaaaaccgataccgcacaggataccaaccgccataatttgctggtaagtcgttccctctggcagatgtgccaatttcaaacgcagcgccaaccagcagaacagactaatacccagtggcttgccaatcagcaaaccagcgatgatccctaatggcagaatggaggtcaaaccttccagcgtgacaccttgcagtgaaacgccagcattagcaaatgcaaacagcggcaaaatcagatacgccacccatggatgcaaaacatgctccagacgtttagccggagagcgcccatgcttctctttcaaaggaataaagaagccgacaatgacgccagccagggttgcgtgaacccccgatttcaacaccgctgtccacagcaccacgccaaccagaatataaacgcccgtgcggcgtacaccacacagattcaataccgcgagtaccgcaattgctacagccgcgacgccaagagaggccatcgataagtcattagtgtagaacaatgcgatgataatgatggccccaagatcgtcgataatagccagagccatcaaaaagatcttcagcgctaacggaacacgacttcccaacagcgccaacacaccaagtgcaaaggcaatgtcagtcgccgccgggattgcccagccttcgcgggtaatcggatcggcatagttaaaagccagatagagcaatgccgggacaatcatcccgccgattgcggcaataacaggaaatgccgcctggcgcagactggccagcgaaccttgcatcagctcgcgtttaacttccagaccaaccaacaggaaaaataccgccatcagagcgtcattgatccatagcagcatgttcttgttgatctcaagtgtcccaacccggagctgaaccggcgtctcaagaaagtcgtgataccatccactggttgcaccgctgttggccataatcatcgctaatacagcggcaataatgagaataatgcctcccgaggcatcactgctaaagaatcgatgcagatgtttcactttttatttctcttcaggtgaatagatcgttttcacgattttaccccgcacgaatcatcgttaaaatcagattatagtgtaggaatagctcgctttttacgatctattaaaagaattgcgccatcagcgagagatgagtttttgatgcccgaaagcggcggctgatgaccttaaaccccattaatcatagtctaatgtcaagatttctgaagaaattattcggaaaagtaataattaaattgttccatgctctagttttttattccacagatgtttgaggatatctaatgtagaaacgacattcgcaggagacattcggttcaatgatataaggaaaggatggttctccacaaagtggataaaacgcgtcgcactgttcaatgttgcatgccgcatctcgcggactttcttactgccagtgagattgcatacagccattgaataattgcggttagaaaatgcacgccagacattatttcgtaccccaccactaaggaataatcgcggtggaaaatcaatggtggcgggtgccacaccgcgctctttgacaaaggaaatatggcagcgaccttgatgaatatgctgcaaattagccatcaggcagccgcccaatataaagcattcgtgatcaaggtaatgctgaacgttgttggaatgctcatcggtcagtattctgaccagttcaaaatgacgatatgccggaagaaccggttttaccaacattcccggatcgttttgatgtaaaactgccgggccgtaatcaatatcaaacaaggtatcccgccgcatagtaagtaactctttgcgctggacatgatgtgccagcgtccctggagacatacgctcttcatagttcgatgtgtattgataatgttgctctacggcagatggggagtaattggttgagatggcaaccaccctgccgctttgttcttctgcggtaacaagagcataaagagagttattgctaccattatacttgacgcgaaaagcgcgggtactcagggtaatatcagaagcagggaaacactgtcgactttctttatagtttgcttcacgcgctaattttaacagttcacggctaagtccagtgctgttaagacgtaatgactttctgatatccgcaagtgcctccccttgctcaatcatcaatgctaacagggctcctcgtggtgtggtaattacatgttccagagtgataaatgttttctcacaatgatggcaatacattcttctctggccttgtgcagaatatccatattttttgagggacgtgcctccgcaagttgaacattggcaaatcaaacctctccaggagtgattcacaatattacgataaatattaagcgactgttcagatatcactggaaacaagtaaccacattcacggcataaaatatttttaccctgtgcgacataatcctggctattcagcaaccccaggtttttacatcctggtgttttgcaacaatcaacatttacgttggtaaacatatccactccctgcgaatagccgtatcttgatattgttcaacgcgaaaagaacctgattcaatgcgtagcactgaatcaggcgggcatagccctaaatggcatacattacatttattatgattatcaggttagccccaggtcaccgcttctggtttatcacctctggctttcattagagaatcattatcaatatcagttttatattttaaaaacttaccatacatctgtttttcaatatctgtttttttaccgatcagattaagtgtttcataacgatcagatttcagattgtagagatatttcggtttattattgcgatcgataatcatcttccagtcaccatcacggatcgcccattcatcggttggatcatcctggaatggcatatcaatcccgaaaattaatggcttttcgcgtttcaatgctttttgctcaagaacaggaaccagcgattcaccatcgaaagtacggtctgtaggtaatttgaagttcatcattttcgctaaagtaggcatccagtccagaccataaacgggtgtatctgaaaccattccctgtggtagatgtttaccatatttaataatggctggaacacgaattccgccttcccaaaggttatccttgcgaccgcgtaatccatccgtttcccctgccaaattcagctcatacactttgcgcgcttcacgcgttaccggaccgttatcactggtaaaaataacgattgtgttatcttcttcacccacagctttgattttatccagcacttttccaacctgtgcatccagatagctgatattggcataatattcccccacaccacgccagggtttgtctgcccagtcgccataaaataaatcaggatgctgcttctgatacgcgctcatatattgtgagtacatatcgaggtattttttgggcgaagccagggggctatgcacttcggtaaaagcaacatagaggaagaaaggcttgctgtcctttttgttatccagccagttgacgacttccgaactgacatactcaccgctcattttatcagctcgtggagtgggttgcccgttacgtagccagcctgtcgggtaaaccatgccataacgcgggcgttctttagcgttatccagcgtggcgtcggtaacaaagcccgccgtattaaccagtgagtaatcaaagcccatatcttgtgcttgtggctgatcggtgcgatcgccgcctgcattcagatgcagcttacccatcattgccgtgtcgtacccttgcgctttgagtagattagcaatcgtgagttcgttacgccctaaggcaacatctttgcctgaaggaatccatgagcgaattccagtacgaaatggcatccggccggttaatagccctgcgcgtgaaggtgaacttaaaggagcgggggcatagtagtcagtaaatttgaccccttcctgggcaagcctgtcgatattaggtgttttaacgatctgatgaccatatgttgctaaatcgccataacctaaatcatccgccataataatgactaaattaggttgtttagcctctgcggctaaggcaggactaaaagcattccctgtgcaaactgcaaggccgatcaaactggccattaacgttttctgcataattattccctgataaaaattagaaatcataaccaagcatataaatcatttgatcgccaaagccatcgtagcccagcttattatcgaaataacgccacgtcacactggctttccagcgaggatagaacttccaggcaatagttaaaccgccatttaacccgttccggccaaattgctgctccgtgtaagcatcgttcctgtccagttctatttcattccagttagataaaacaaatttttcgtcaaataacgtaaatggtaatactgctgtccagccaacaacataaccattccaaccattcgtttgaccatatttagctgatacgtagtcaccagattgattatgcaatccaatatacggtttaaaaaagccccactcgccgttccagccgaggtaaccgaatccataaaacatgtccagatcgtcaccccatgagttatcccattggccataaattttgccaaagaatgtcatatcagagtcaaagagtctgacatgcgtcattgctgaaaccgtatgatttctccctgctacagcatgattgagtacattactttcataaaatgagtaaaattctgcttctttaaaatttaccccaaaatccgcagtcactttccatacttcaccacggtgagtgtttacaaatccactattccagtctgcataacccgcatttattgaaccaaaggatcctttatattctaatgaagaatatgcaggaaaatgatagatagctgttatcaaggtacacgcaataagaagtcgtcttttggcagacatataatatgttctccattcattgtttttatgattccataggaattaatacaccagacaattcatttttattaagaatgaccaggccagtatatttaaagatgactatcgaagcgtgatgaagatcgcagattacttttgcgaacgggcggagggatatcgtgtttcagaaaatgtgtctgttttaaacatcaccctttgatttataggcatttttcatgatgaacttagcattggctgctgaacgtatttctttgtctctctatagtattacagtaacctttaataattaatttcctttagccattcacttttgatagaggaaaacacctttttttgtgaattcctggatatatttaagttaaataaattgatgtattgaaatattattccgcaaaaatgcgaggcgtcttcagaaaaagaattgataaaacagaagtgaattaaaagcgcagtataatagcggcgggtgcttgaggctgtctgtctcaggcattagctgaacggcagatagagaaaagccccgagtgatattttaccatcaacccgaggccccctatatgcagaacacatgtagagtgcctcttactgaccgaaaggtcaaggagaagagagcaatgaagcagcataaggcgatgattgtcgccctgatcgtcatctgtatcaccgccgtagtggcggcgctggtaacgagaaaagacctctgtgaggttcacatccgaactggccagacggaggttgctgttttcacggcttacgaatccgagtaagagcaacggcggggagtgatccccgccactttacaggtactcgcatatcttcaacgcaccctggtttttaccctggcctgcccacgggcaggcttttggggaggttagcgagtcaggtcgtcaaaaaacttcttcacgccatcaaagaagctctttgaacgcgggctgttgtgctcgccggttgggccaccaaagctttcttgcagctcttgcagcagctgtttctgcttctcgttcaaacctaccggtgtttcgacaacaacgcggcatagcaaatcaccctgtgcgccaccgcggacagacttgacgcctttaccgcgcatacggaacagcttaccggtctgggtttcgccaggcactttcagtttgacgcgaccatcaagggtcggtacttcgatttcaccacccagcgccgccatagcgaagttgatcgggacttcgcaatacaggttgttgccttcacgctcgaaaatcgggtgctgtttaacctgaacctgaacgtacagatcgcctgccggtgcgccgtgttcacccgcttcaccttcgcccgcaagacggatgcggtctccagtgtccacccctgccgggattttaacggacagcgttttgctgcgctcaacacgaccatgaccatgacatttgttgcacggatctttgatcagcgtaccgcggccctgacagtgtggacaggtctgctgcacggcaaagaaaccctggcgcatctgcacctggccagaaccatgacaggtcggacaggtctgcggctgtgtacctggttttgcaccgctaccgtggcaaacgtcacactcttccagagtcggaatgcggatctctttggtcacgccacgtacagcttcttcgagggtgagctccatgttatagcgtaaatcagcaccgcgcgccgcacgttgacgaccacgtccgccgccaaaaatatcgccgaaaacgtcaccaaaaatatcgctgaagtctgcgccgccgccaaaaccgccgccgcccatgccaccttgctcaaacgcagcatgaccatactgatcgtatgccgcacgtttttgcgagtcggtcagaacttcataagcttccttgatctctttaaatttcgcctcggcctctttgtcaccctggttacggtccgggtggtatttcatggccaggcgtttgtaggcctttttgatttcacgctcttccgctgttttggaaacgcctaaaatctcgtaataatcttgcttagccatcttttttaaattgcccctagatgaatgcacgggcggagaggaaatcccccttcgcccgtgtcagtataattacccgtttatagggcgattattttttgtctttgacttcttcaaattcagcgtcgacaacatcgtcatctttcgcgttgtttgcagaagcatcagcaccggcagtctgctgctgggcatgttgctgctgggcgatttccatcagtttctgggaaacctgtgccagttcctgcattttcgcttcgatagcggctttgtcttcacctttcagagcagtttccagtgcagtcagcgcagactcgatagcagttttgtcgtcagccggcagtttgtcgcctgcttcttcaacctgcttacgggtgctgtgcagcagatggtcgccctggttgcgagtctgtaccagctcttcaaacttacggtcagcttcggcgttagcttctgcgtcgcgtaccattttctggatttcatcttcgttcagaccagaagaagccttgatagtgatcttctgctctttaccgctgtttttgtctttcgcggaaacgtgcaggataccgtcagcatcgatatcgaaggtaacttcgatctgcggcatgccgcgcggtgccgggttgataccatccaggttgaactgacccagagatttgttatcagccgcacgtttacgttcaccctgcagcacatggatggttaccgcagactggttgtcttcagcggtagagaacacctggctgtgcttggtcgggatagtggtgtttttcgcgatcagcgtggtcatcacaccgcccatggtttcgatacccagagacagcggggtaacgtccagcagcagtacgtcttttacgtcaccagtcagaacaccaccctgaacagcagcaccgatggctacagcttcgtccgggttaacatctttacgcggctctttaccaaagaattcagcaactttcttctgaaccattggcatacgagtctgaccaccaacgagaataacgtcgtcgatatcagatacggacaggccagcgtcctgcagtgcaactttcagcggctcaatggaacggtttaccagatcttcaaccaggctttccagtttcgcacgagtcactttgatgttcatgtgtttcggaccggtcgcgtctgcagtgatgtacggcaggttaacgtcggtctgctgagcggaagacagttcgattttcgctttttctgccgcttctttcaggcgctgcattgccagcggatcgttgcgcaggtcaatgccctgatctttcttgaattcttcaaccagatagttgatcagacgactgtcgaagtcttcaccacccaggtgggtatcaccgttggttgccagaacttcgaaggttttttcgccgtcaacttcgtcgatttcgataatggaaatatcgaaagtaccaccacccaggtcataaaccgcaatagtacggttgccagtacctttgtccagaccgtaagccagcgcagctgcggtcggttcgttgatgatacgttttacttccagaccagcgatacggcctgcgtctttggttgcctgacgctgagcatcgttaaagtatgccggtacggtaataacagcttcagttaccggttcacccaggtaatcttcagcggttttcttcatttttttcagcacttcagcagagatctgcggcggtgccattttctggcctttaacttcgacccatgcgtcgccgttatcagcagcaataattttgaacggcatgatggaaacatcacgctgtacttcttcgtcctggaagcggcggccaatcaggcgtttaatcgcaaacagggtgttttgcgggttcgtcactgcctgacgtttagccggctgaccaaccagagtttcaccatcctgggtataggcaatgatagaaggcgtggtgcgatcgccttcggcgttctccagtacacgaggagtggtgccatccataatcgctacacaagagttggtagtacccaggtcgataccaattattttacccatctaaacgtctccactatatattcggtcatcatgtggttgtgagtctgtaataggggcgaaacgtctggtttcaactgcccaatttcatttttttgcagactcactcactgcggttgactactaaatggggtcgtaacccacgtcatcaagggggagatgcaaaaattttttgtgcttttgcgcagaaatttcgcgatatggcaggacaagacgtgaaactgacagcaattttattcatataaagaatgaatcgcagtcaaggcattcatcaaaaaattgtaataaaaagaaaatattacgtgcctgaaacttctctttatcagcagtaaactagtttcatccccctacccctccccaccaagagaatccttatgaaatccgttattacgatttccgccagcctggcgattagcctgatgctgtgctgcacggcgcaggcaaacgaccataaaatcctcggcgtcattgcaatgccgcgaaacgaaaccaacgatctggcgctgaaacttcctgtttgtcgcattgttaaacgcatacagctctcagccgaccatggcgatttgcagttaagcggtgcatcgatttatttcaaagccacccgaagcgccagtcagaccctgaatattccttcagaaataaaagaagggcaaaccactgactggatcaacattaacagcgataacgacaacaaacgctgcgtctcaaaaatcaccttttccggtcatacagtgaactcatcggatatggccacgctgaaaattatcggcgacgactaacgccagaatatagaaaccacaaaaaatgaatgttaattacctgaatgattcagatctggattttctccagcattgtagtgaggaacagttggcaaatttcgcccggctgctcacccataatgaaaaaggcaaaactcgcctctccagcgtactgatgcgcaacgaactgtttaaatcgatggaaggacatcccgagcgacaccgccgcaactggcagctgattgccggagaattacagcattttggtggcgatagtatcgccaacaaactgcgcggacacggtaaattgtatcgcgccattttgctcgatgtttcaaagcgattgaagctgaaagccgacaaagagatgtctacgtttgaaattgagcaacagttactggaacaatttctgcgtaatacctggaagaaaatggacgaggaacataagcaggagtttctgcacgcggtcgatgccagggtgaatgagctggaagagctgctgccgctgctgatgaaagacaaattattggcaaaaggtgtgtcgcatttgctttccagccaattgacccgcattttacgcacccacgcagcaatgagcgtgcttgggcatggtttgctgcgcggcgcgggtctgggaggccctgtgggcgcagcattaaatggggttaaagcggtcagcggcagtgcctatcgcgtgacaattccagccgtactgcaaatcgcctgcctgcgccggatggttagcgccactcaggtctgataccggaaaccggggaaaattttcattttcccctcaaaagatcgtagacactgccccactggctgattattatgccgcgccctgaaaacactacagttattcagggaaattatttcaccattcattcgatgatgatttttgaggaattatgggcaacactaagttggctaatccggcaccgctgggcctgatgggcttcggcatgaccaccattctgcttaacctgcacaacgtgggttattttgctctggacggtattattcttgccatgggcattttctacggcggcatcgcgcaaatttttgccggtctgctggagtacaaaaaaggcaacactttcggtttaaccgcattcacctcttacggttctttctggctgacgctggttgcaattctgctgatgccgaaactggggctgaccgatgcgccaaatgcccagttccttggtgtctacctgggtctgtggggcatatttacgctgtttatgttcttcggcacgctgaaaggcgcacgcgttctgcaattcgttttctttagcctgaccgtgctgtttgccctgctggcgatcggtaacattgccggtaacgccgcgatcatccactttgccggctggattggtcttatctgcggtgccagcgcaatctatctggcgatgggtgaagtgctgaacgagcagtttggtcgcaccgttctgccgattggtgagtctcactaattgttaagctccccccgctcgaagggataagattgttaacaacgtgcgctttgtttatgccggatgcggcgtgaacgccttatccggcctacaaaatcgtgcaaattcaatatattgcaagaagatcgtaggcctgataagcgtagcgcatcaggcagttttgcgtttgtcatcagtctgatccccccgcctggggggatttttttattcgctaacttcgcgtcttgcactcttcggtctgaatgctgcaaccacttccggtgccgtttcaacgtatggcccttccagcaactgaatgcagtacggtacgctggcaaaaataccgtgcaccacaacgttaccctcagcgtccttcacaccttccagcgtctctttaatagacttcggttgaccgggtaagttaaggatcagcgcctgtttgcgaatcacccccacctgacgcgaaaggatcgcagttggtacaaaatgcaggctgatctggcgcatctgttcaccaaagcctggcatctcgcggtccgctactgccagcgtcgcatcgggcgttacgtcacgacgcgcagggccagttccgcccgtggtgagcaccagatggcaactcatttcatccaccagctcacacaacgtttgctcgatgatcgcctgctcatcggggattaagcgggtttccagttcaaacggcgtggttagcgccgatgtcagccattcttccagcgcagggatgcctttatcctgataaacgccgctggatgcgcgatcagagatggaaactaagccaatacgtaaagtattcatcaagatttttccgtttaaacagtctcgttaaacagaatgatacactgcgaagggagtgacagacaggtttcagaagaggtagcgtgaccgacttcccggtcacgctaagtatgattacagcagatcgccgatcattttttccagtttttcctggtcaacagcaaacttacggataccttccgccagtttatctactgccattggatcctggttgtgctgccacaggaactcggactcagtgatacgcgccggacgcgctttcacttcaccagtgtaagacagtttacgttcgatagccccttcgctctccgccagctctttcagcagtgccggtgcgatggtcagacggtcgcagcctgccagttccagaatttcgccgatgttacggaagcttgcgcccataaccacggtttcataaccatgctctttgtagtactggtagatttcagatacagaaaccacgcccggatcttctgccggagcgtactctttcttatcggtattcgctttgtaccagtcaagaatacggccaacaaacggcgagatcaggaacacgcccgcttccgcacaagcacgagcctgagcgaaggagaacagcagggtcaggttacagttaataccttctttttccagctgttctgcagcacggataccctgccaggtagaagccagtttgatcagaatacgatcgttgctaatacctgcatcgttgtagagtttgatcaggcgttttgctttcgcaattgacgcttcggtgtcataggaaagacgcgcatcaacttcagttgagatacggcccggaaccagtttcaggatttccagaccaatatttactgccagtttgtcggtcgcgtccacgatctgctgcgcgcgatcgttgctctgctgtttcgcccaggcgacagcatcatcaatcaacttacggtattccggaatctgcgctgcgttaagaatgagagaagggttggttgtggcatcctgcggttgatacagcttcattgccgcgatgtccccagtgtcggccactacggtggtgtactgacgaagggaggtcaatttgtccgtcatgatagtatttctctttaaacagcttgttagggggatgtaaccggtctgccctgatgatatcacgacgcaacgtcagcgcaaccgccgacaagacggttatcgccaggcgagactgtttcggatttctgacactgcgttgatatcgcccgccatttttatacaaaacctcatgtatgctacgcagaagttatcaagtacctcgtagcgtatatacttcttaaacaattggtaacgtttacacaggaaagtcatcgcgaccggcaataagagggatatgcatgccagattttttctcctttattaacagcgtcctttggggatcggtaatgatttacctgctcttcggcgcaggttgttggttcacttttcgcaccggatttgtgcagtttcgctacatccgccagtttggcaaaagtcttaaaaatagcattcatccacagccaggcggtttaacctcatttcagtcattgtgtaccagtcttgcagcgcgcgtgggtagcggcaacctggccggcgttgcgctggcaattaccgccggtggacctggagccgtcttctggatgtgggttgccgcatttatcggcatggcgacctcgtttgccgaatgttccctcgcacagctttataaagaacgtgatgccaatgggcagtttcgtggcggaccggcatggtatatggcgcgcgggctggggatgcgctggatgggcgttctgttcgccgtctttttgctcatcgcctacggcataattttcagcggagttcaggcgaacgccgttgcgcgagccctgagtttttcttttgattttcccccgctggtaacaggtattattctcgctgtctttgctctgctggcgatcactcgcggtcttcatggcgtcgcccggctcatgcaggggtttgtcccgttgatggcgataatctgggtactgaccagcctggtgatttgcgtaatgaatatcgggcaacttccccacgtcatttggtctatttttgagagtgcttttggctggcaggaagctgcaggcggcgcggcgggatataccttaagccaggcgattactaacggttttcagcgcagtatgttttccaatgaggcgggaatggggtcgacgccaaacgcggcagcggcagctgcgtcctggcctccgcatccggcagcgcaaggaattgtccagatgattggcatttttatcgacaccctggtcatctgcacggcaagcgccatgctgatattactggcgggtaacggcacaacctacatgccgctggaaggtattcagcttatccagaaggcgatgcgggtgctaatgggttcctggggtgcggagtttgttaccctcgtggttattctgtttgccttcagctccatcgttgccaactacatttatgccgaaaacaatctcttctttttacgcctgaacaaccctaaagcgatctggtgtctgcggatctgcaccttcgcaacggtcatcggcggcaccttgctaagttttccgctgatgtggcaactggcagatatcattatggcctgcatggctattaccaatttgaccgccatattactgctctcgcctgtggttcataccattgccagtgattatctacgccagcgtaaactcggcgtgcgcccggtgtttgatccgttgcgttatccggagatcggtcgccagctttctccagacgcgtgggatgatgtttcgcaggagtaatcacaactatcgatcaactcattctctttttttgctaaagtcggcataaatttcctgcaaggactggatatgctgattcttatttcacctgcgaaaacgcttgattaccaaagcccgttgaccaccacgcgctatacgctgccggagctgttagacaacgcccagcagctgatccatgaagcgcggaaactgacgcccccgcagattagctccctgatgcgcatcagcgacaaactggcgggtatcaacgccgctcgctttcatgactggcagccaaatttcacaccggagaatgcccgccaggcaattctggcgtttaaaggtgatgtctacactggcttgcaggccgaaaccttcagcgaagacgatttcgattttgcccaacagcatttgcgaatgctttccggcttgtatggcgtactgcgcccgctcgatttaatgcagccttatcgtctggaaatggggatacgtcttgagaatgcccgagggaaagatctgtatcaattctggggagatatcatcaccaacaagctgaacgaggcgctcgcagcacaaggcgataatgtggtgataaatctggcgtcagatgagtattttaaatcggtgaagccgaagaaattgaatgccgagattatcaagccagtgttcctcgatgagaagaacggcaaatttaagatcatcagcttctacgctaagaaagcacgcggtctgatgagtcgtttcattattgaaaatcggctgaccaaaccagagcaactgactggttttaatagcgaaggttacttctttgatgaagcttcctccagcaatggcgaactggtgtttaaacgctacgaacaacgttaagtttgtagtcaatgccggataatgccggatggcaatccggcattgatatttagcgatgatgtttgtcaggccccggacgatgatcgccacgatgatcattgtgcttgttatggcgcggcgatgacggcggtccatgtgggtgccagcgattgcctcgccattcataatgttgtttccaccagccgtggtcgcgccaatgaccgccatcccagtaatagccacgattatcacgatcgcctatctgtaattttactgacgggactagcgtaatttccgcagcctgcgctgccatgggagcgaccagaaccagggaaagtgcgagtacgatagattgcatctttttcacaggttactccttttatcattgcccgttatgggtcgatatccggagattacgcgatgagaacggcagttgttattctccgcaatcctaatctctaagttaccgcatttattgagaatttctcctttttccctgtcgtttttctccatattttcttcataaaaaaagccgggctgcataaaagcaaacccggcctgattgagataatgaatagatgttactgatgattcatcatcaatttacgcaacgcagcaaaatcggcgggcaggttatgcgaaagcaagggtaaatcagcacgttctgccagctcttttggcagatccaacgtttcaccgagaatcgcttccacgctctctttaaatttcgccggatgcgcggtgccgaggaacaagccatattcgcctggattcaactggtcacgcagcgcacgataagctacggcagcgtgcggctccgaggtatagcccagttcttttaactcacgcattgtctgttgcgtggtttcatcatccacggctgcataacccagctctttcagttgccagattttgcggcggaacaactcttccacacgcggccagttgtttggctggctaacatccatcgcattggataacgtcgcctgagtcgctttgggtgaccactgaccgtcgtgcaggaaacgtggtacggtatcgttcacgttggtcgcagcaataaaacgttttaccggcagaccgagtgacttcgccagcagacccgccgtcaaatcgccgaagtttccactcggtaccgagacaaccaactggttacgtgcttcttgcggcaactgtgcgacagcctcaaagtaataacaaatctgcgccagcaagcgactgatgttgatggagttagcagaattcagccccagcgccactttcagttcttcatcatcaaacgcctgcttcaccagcgcctgacaggcatcgaaatcgccgtcgatggcaacagtttcgatattgccgcccaatgtacagaacagtttttcttgcagtggactgattttgcctcgtggatagaggataaccactttcacattcggtaaaccgtagaaagcatgagccactgccgctccagtatcaccggatgtcgcggtcagaatggtcactggcttatcgcccgcaatatgggtcagcatttgtgccataaagcgaccgccgaaatctttaaatgccagcgttggcccgtggaacaattccagacaaccgacatcgctttcaacattggcgaccggagccgggaaggcaaacgccgcacgtacgcgctcttccaggatttcctgcgggatttcatcaccaataaacgccgagaggatcttcgcactgcgggtgacaaaatccagcttcagcatctcatcaatttcagtcaggctgaattccggcaggtcgtgcggaaaaaacagcccctgatttttgcctaacccctgggttacggcttgcgcaaagctgacctgctcattgtgatctttcagattgtagagtttcatttagttttccagtactcgtgcgcccgccgtatccagccggcaaatatgaacaaaaccttcctgattttgcaggtagttcttacccaaccagtcggcaacgcgctgggcggtatccggcttgtcacacagagcgaacaaagtcgggccggagccggagataccgctcgctaccgcgccgatttccgcaaccgcctgccgcgcctgccggaagcctggcagtaaccgttcacggtagggttcagcgataacatctttcatcagcttcgcggcaagctcaagctgacgggaatagcaggcgtgaatgaagcctgccagatgtcgcccgtgcgcaatgcaatcctggcggcgatactgcgccggtaaaatagccctggcttctgccgtcgagactttaatccccggatacgccagcacccacagccactcatcaaaccctggcacttgctggctgatgatgtcgttttcttcgatcatcaactgcataccaccaagaaaacacggtgccacgttgtcgtaatgaatgctgccggagatacgcccttccaactcgcccatcaaagccagcaaacgagtgtcattaagcggcttgccgcagtgttcattcatcgccatcagcgccgcgaccactgaacaggcgctggagcctaagcccgaaccgatcggcatattcttttccagagtcatcgccactggaatttgcttgccaagctcctggcaaaaacgctcccagcactgataaacgatattttcccgtggctctgacggcagcttatcggcaaagcgtccgaggttgttgagactgaatgtctctgccgcctcaaccgtgactacatctccgagcaatgcaccatcaacaggtgtcaccgccgccccgagcacatcaaacccgacgctcatattggcactggaagccggggcataaactttaaccatgtcagactcctaacttccatgagagggtacgtagcagatcagcaaagacaccggcagctgtaacgtcattgcccgcaccatatccgcgcagtaccaacggcagcggctgataatagtggctatagaaggccagggcgttttcgccatttttcactttgaacagcggatcattaccatccacttcggcaatcttcacgcggcagacgccatcttcatcaatattgccaacatagcgcaaaacttttccttcatcacgggccttcgccacacgcgcggcaaagagatcgtcgagctgtgacagattcgccataaaagcggcgacatcaccctcggcgttaaactctgcgggcagcacaggttcaatttcaatatccgccagctccagttcacgtcccgtttcacgagcgagaatcaatagcttacgcgccacatccataccagaaagatcatctcgcgggtccggttcggtataacccatttcccgcgccagtgtggtcgcctcggagaaactcatgccttcgtctaacttgccgaagatataagaaagcgaacctgaaagaatgccggagaacttcatcaattcatcaccagcattgagcagattttgcaggttctcaataaccggtaatccagccccaacgttggtgtcatagaggaatttacgccgcgatttttccgccgcataacgcaactgatggtagtaatccatcgacgaggtgttggcctttttgttcggcgtaacaacgtggaaaccttcgcgcaggaagtcggcatattgatctgccacagcctggctggaagtacagtcaacaatgaccgggttcagcagatgatattctttcacgaggcgaattaagcgcccgagattaaacggctctttggcttgcgccagttcttcctgccagttttccagattaaggccatgtacattggtgagcagtgccttcgagttagcaacaccgcagacacgtaagtcgatatgtttattcttcaaccagctttgctgacgcttcagttgctccagcagcgcaccgccaacgccaccgacgccaatcacaaacacttcgataacctgatcggtattgaacagcatctgatgagtaacgcgcacgccagtggtcgcatcatcgttattgaccacgacagagattgagcgttcagaagatccctgagcaatggcgacaatgttgatattggcgcgggccagcgcggcaaagaatttcgccgagatcccacgtaaggtgcgcataccatcacctaccaccgagataatggccagccgttccgtcaccgccaacggctccagtaagccttctttcagttccaggtagaactcttcctgcattgcccgttcagctcgcacacagtcgctttgcggaacgcagaaactgatactgtattcggaagatgattgcgtaatcagcaccacggaaatacgggcgcgtgacatcgctgcaaagacgcgcgccgccatgccaaccatccctttcatccccgggccggaaacgctgaacattgccatgttattcagattggaaatgcccttgaccggtaattcgtcttcatcacggctggcaccaatgagcgtacctggtgcttggggatttccggtatttttaatcaggcaagggatctggaactgggcgatgggggtaatggtgcgggggtgaagaactttagcgccgaagtaagaaagctccatcgcttcctgataggacatcgacttcaacaacctcgcatcgggcacctgacgcggatcgcaggtataaacaccgtcaacatccgtccagatctcgcaacaatcggcgcgtaaacaggccgccagcaccgcagcggagtagtcggaaccgttgcgtcccagaaccaccagctcgcctttttcattaccggcagtgaaaccagccatcagcaccatgtggtcagccggaatgcggcttgccgcaatacggcgggtggattcagcaatatcaacggtagattcgaggtaatgacccactgccagcagtttttcgaccggatcgataacggtaacgttgtgaccacgcgcttctaacacgccggccataatggcgatcgacattttctcgccacggcaaatcagcgcagcgttgatgctatccgggcactgccccaacaaactgatgccatgcaggacatgttttatttgggcaaattcctggtcgacgaaagttttcaattgtgccagcggaaatcccggctgggcggcggcgagtcccgtcagaagttcggcaaaaatacgttcggcatcgctgatattgggtaaagcatcctgaccgctaatggttttttcaatcatcgctaccagatggttggtgattttggcgggggcagagaggacggtggccacctgcccctgcctggcattgctttccagaatatcggcaacccgcagaaaacgttctgcatttgccactgatgtaccgccgaacttcaacactcgcatggttgttacctcgttacctttggtcgaaaaaaaagcccgcactgtcaggtgcgggcttttttctgtgtttcctgtacgcgtcagcccgcaccgttacctgtggtaatggtgatggtggtggtaatggtggtgctaatgcgtttcatggatgttgtgtactctgtaatttttatctgtctgtgcgctatgcctatattggttaaagtatttagtgacctaagtcaataaaattttaatttactcacggcaggtaaccagttcagaagctgctatcagacactctttttttaatccacacagagacatattgcccgttgcagtcagaatgaaaagctgaaaatcacttactaaggcgttttttatttggtgatatttttttcaatatcatgcagcaaacggtgcaacattgccgtgtctcgttgctctaaaagccccaggcgttgttgtaaccagtcgaccagttttatgtcatctgccactgccagagtcgtcagcaatgtcatggctcgttcgcgtaaagcttgcagttgatgttggtctgccgttgtgtcacttttcgccggttgttgtattaatgttgctaattgatagcaatagaccatcactgcctgccccagattgagcgaaggataatccgccaccatcggcacaccagtaagaacgtcagccaacgctaactcttcgttagtcagcccggaatcttcgcgaccaaacaccagagcggcatggctcatccatgaagatttttcctctaacagcggcaccagttctactggcgtagcgtagtaatgatatttcgcccgactgcgcgcagtggtggcaacagtgaaatcgacatcgtgtaacgattcagccagtgtcttgaaaactttaatattatcaataatatcaccagatccatgtgcgacccaacgggcggctggctccaggtgtgcctgactatcaacaatccgcagttcgctaaaacccatcgttttcattgcccgcgccgctgccccaatattttctgctctggcgggtgcaaccagaataatcgttatacgcatattgccactcttcttgaccaaataaccgcgaacagggtgatcattgtcaacttattacgcgttgcgaatttacaaatctttaacgtaagtcgcaggaaaagccctttgcttagcttaaaaaaggctaaactatttcctgactatactaacgattgaattgttaaaaaatgctacatatccttctgtttacttaggataattttataaaaaataaatctcgataattggattcaccaggtttattagttgtatgatgcaactagttggattattaaaataatgtgacgaaagctagcatttagatacgatcatttcatcaaactgttaacgtgctacaattgaacttgatatatgtcaacgaagcgtagttttattgggtgtcctgcccctcttagcctgttatattgctgttaaaatggttaggatgacagccgtttttgacactgtcgggtcctgagggaaagtacccacgaccaagctaatgatgttgttgacgttgatggaaagtgcatcaagaacgcaattacgtactttagtcatgttacgccgatcatgttaatttgcagcatgcatcaggcaggtcagggacttttgtacttcctgtttcgatttagttggcaatttaggtagcaaacatgcagaccccgcacattcttatcgttgaagacgagttggtaacacgcaacacgttgaaaagtattttcgaagcggaaggctatgatgttttcgaagcgacagatggcgcggaaatgcatcagatcctctctgaatatgacatcaacctggtgatcatggatatcaatctgccgggtaaaaacggtcttctgttagcgcgtgaactgcgcgagcaggcgaatgttgcgttgatgttcctgactggccgtgacaacgaagtcgataaaattctcggcctcgaaatcggtgcagatgactacatcaccaaaccgttcaacccgcgtgaactgactattcgtgcacgcaacctgctgtcccgtaccatgaatctgggtactgtcagcgaagaacgtcgtagcgttgaaagctacaagttcaatggttgggaactggacatcaacagccgttcgttgatcggccctgatggcgagcagtacaagctgccgcgcagcgagttccgcgccatgcttcacttctgtgaaaacccaggcaaaattcagtcccgtgctgaactgctgaagaaaatgactggccgtgagctgaaaccgcacgaccgtactgtagacgtgacgatccgccgtattcgtaaacatttcgaatctacgccggatacgccggaaatcatcgccaccattcacggtgaaggttatcgcttctgcggtgatctggaagattaatcggctttaccaccgtcaaaaaaaacggcgctttttagcgccgtttttatttttctaccttatttccagatacgtaattcatcgtccgttgtaacttctttactggctttcattttcggcagtgaaaacgcataccagtcgatattacgggtcacaaacatcatgccggccagcgccaccaccagcacactggttcccaacaacagcgcgctatcggcagagttgagcagtccccacatcacaccatccagcaacaacagcgcgagggtaaacaacatgctattacgccagcctttcaataccgcctgcaaataaataccgttcattaacgccccaatcagactggcgattatccatgccacggtaaaaccggtatgttcagaaagcgccagcaagagcaaataaaacatcaccaatgaaagccccaccagcaaatattgcattgggtgtaaacgttgcgcggtgagcgtttcaaaaacaaagaatgccataaaagtcagcgcaatcagcagaatggcgtacttagtcgcccggtccgttaattggtattgatcggctggcgtcgtcactgcgacgctaaacgcggggaagttttcccagccggtatcattgcctgaagcaaaacgctcaccgagattattagcaaaccagctactttgccattgcgcctgaaaacctgactcgctaacttcccgtttggctggtagaaaatcacctaaaaaactgggatgcggccagttgctggttaaggtcatttcgctataacgcccgccaggcaccacagaaagatcgccggtaccgcttaaattcagcgccacattcagcttcaggttctgcttgcgccagtccccttcgggtaaagggatatgcacgccctgcccgccttgctctaacccggtgccgggttcaatggtcagcgccgtaccgttaacttcaggcgctttcaccacaccaataccacgcgcatccccgacgctaatcacaataaatggcttgcctaaggtgatatttggcgcgtcgagttcgctaagacgcgaaacatcgaaatcggcttttagcgttaaatcactgtgccagacctgaccggtatagatgcctatcttgcgttcttccacgttctgattgccatcaaccatcaatgactcaggtaaccaaaaatgaataaaacttcgtttccgctccacggttttatcgtcttcctgcaccgtataaagctcggtcacaggaatagcgatgagcggtccaacgagtttttgcggcccgctggtactttggcgaatcacatcttccacatcgctacggtaatcggcacgttcgacaatcacctgccgaatcagcattatcggaatcaacaacagcaatactgcaccaaacaaggtggtcattttccagaacaggggggatttcaacatagtcttctcctttgcaatggcagcaggatacgaaggctatgtgggaagaatttgaagctatgtgaagtgacggtgaagtcgaagcgaggccagcacgccaccttcctgcacgttgcgcagcgtgacttcgccgttaaacaaacgggcgacctcactgacaaacgccaaccccagaccgctgcttttttgcccatttgcacgcggcaaagagtaaaagcgttcaaaaatacgtgacagcgcgtagtcaggaatcccactaccggtatccagcaccttaagggtgacgtattcctgatccacttcggcgcttagcgttatgcgaccgctctcgggagtaaaatcgatggcgttatccagtaaattccccagcgcctgctccagtaacgccggttcagcagcaacgttaatctcagtaggcataacatgcaaagtgatgtttttttctgccaactgcacggtgcgcgcttcgctgacgcggcgaaataatgccgccacatcaacagcagtcagaacgacttcctgacgattctccagtcttgcctggcgtagtaacgtttccaccagtgcctgcattcgcgcattttgcgtcagaatgttgtcggtaaaacgagccaccacttccggcggcggaccttcgcgtaaaatttccgccgcgccacgaatcgccgccagtgggctttttagctcatgagttaacgcataaacatactgctcaatatagtttttcccttccagcttcacgcgcatactttccagcgcctgcgcgagtttacgcaactcgctactaccgagatcggggagaggaacgggcttattgtcagtgacggaatcagcatagcgagtgagccgggcaatagagcggttgatccaccaaaccatgcctgcgccaatcaccagtgcaatccccaacaaaatggcgctggcccataaaattcgccgctcgctacgcttaatgaccggagccatcgccgcgttcggtttgcctacgctcaaaacgccaataagccgcgagccgtccataatcggcgcggcaacatacatcacagaactttcgggatcggcaggattttgcaacgtgctgcgcgcaccatactgaccacgcaacgttagccagacgtcattccagcgcgaataatcctgtccaacggctttatttgccgaatcgaacaatactttgccctgcgcatcggtcatatagacatgatattcgttgcgcactttgttaatgccaccgatattggcgcgaaacgggcgatgttgtagctgattaaacgcctgcgccagttgcccatgcgttgggtccccagagagcaaatcgggacgcgccagctccgccagcaacgttgcggtgtcgattaacgtcccctcggttgctcttcgcacgcccggtttaacttctttgacaaaaatagccagtacgaaccaggccgccaccgccaccagtaaaaaatagcccagcaacaaccgcatgccgatacgcattacaggcccctcaggctatatcccatgccgcgatgagtattaatcggtgaaagatcggggttgatggcgcgcagcttggcacgcagcgttttaatgtgggtatcgacggtgcgatcgtaggtgtcctgcgcatcttcccacacgctatccatcagttgctggcgggaccagacgcggcccggcgacttgagtaacgtcttcagcaataaaaactcataccgcgtcagcgttaatggcgtgtcaaaccagctgatctgcgccgcaggttcattcaattcaaaatgaccaatacggataacgggagacggcgtcgagaacttcttcacccgacgcagtaaggtgcgcactctggcgcacacttcgcgaggtgaaaacggtttagccacgtagtcgtcagcgccaatttccagcccaagcaggcgatcgacctcttcacttcgggccgtcaggaacagtacaggtaacgccggatggagcgccagtaactggcggcacaattcaaagccgctgatatcaggcaaaccaacatcgagaatcatgacatcgggaacctgctggcgagctttatccagcactggcaagcctcgctcaaagacctcgacgtcaaaaccttcctgttgcaacatgtagaccagcgtatcggctatcccttgctcgtcttcgactaaccagaccgtttcccgttgcataaatcgcctctgttattgccgccacggcatgacaggaaccgcgctaatcgcgtttttcggcgaaccttctacaactttgtcggagtaagccagataagcgagcgcgttgcgtttagcgtcataaaagcgcacgacctgtaacgacttaaagaccagggacgtgcgttttttgaatactacctcgccctgagctttgccgtttttaatacgatccgacagttcaatcggcccgacttgttgacaagaaatggccgcatcggaggtatcttctgccaggcccaatccccctttaataccaccggttttcgcccggctcacataacaggtgacatttttcacatcgggatcgtcaaaggcttcaacaacaattttgtgatccgggccgatcattttaaatacggtgtcgaccgaaccaatctcttctgcatgagccaatggccccagcattatcaggcttaaagacaggattaaatgcttgtatttcatatcgttaccatttttatctattacacgagcaattagttcgtcacggtaaataacatattgattaagaacaaaatctcaatacttttatttccgtcaagacctaaaacatactcgactaagaaaaaaacactgaatgctaaaacagcaaaaaatgctattatccaattacctgatgtcaggtgctcgttgttgaaaggatgaggatattttatggatcaggccggcattattcgcgaccttttaatctggctggaaggtcatctggatcatcccctgtcgctcgacaatgtagcggcgaaagcaggttattccaagtggcacttacagagaatgtttaaagatgtcactggccatgctattggcgcgtatattcgtgctcgtcgtttgtcgaaatcggcggtcgcactacgcctgactgcgcgtccgattctggacatcgcgctgcaataccgcttcgactctcaacagacatttacccgcgctttcaagaagcagtttgcccagactcctgcactttaccgccgttctcctgaatggagcgcctttggtattcgcccgccgctacgtctgggtgaattcactatgccagagcacaaatttgtcactctggaagatacgccgctgattggtgttacccagagctactcctgttcgctggagcaaatctctgatttccgccatgaaatgcgctaccagttctggcacgattttctcggcaactcgccaaccattccaccagtgctttacggtttgaacgaaacacgtccgagccaggataaagacgacgaacaagaggtgttctacaccaccgcgttagctcaggatcaggcagatggctatgtactgactgggcatccggtgatgttgcagggcggcgaatatgtgatgtttacctatgaaggtctgggaaccggcgtgcaggagtttatcctgacggtatacggaacgtgcatgccaatgcttaacttgacgcgccgtaaaggtcaggatattgagcgatactacccggcagaagatgccaaagcgggagatcgcccaattaatctgcgctgtgaactgctgattccgatccgtcgttaacgctgcagctcatctaatgcaggggcgtccagatgcgagatgtcccctgcggtttcaaccacccagccagacgccagccacaagctttcctgataatccacgcgcgaaatagaacagttacgcagacgtaagcggcgctctgcccatgctggtaatccgagaatcgtactcaccaggcatcccagtgcaataccatggctcaccagtagcggtcggcttccctgcggtaagtcccggcaagattccagtgccgcattaacgcgatcgctgagctcctgcattgactcaccttcaggaatacgcccgtcaacggtgccattgaccagttgccgacgccagttctcttcttcttcggtgagtgaatcgatatttcttgtttccagtacacccatatttaattcacgcaggcgagaatcaaagatgatgtcacaaccgcaggcctgggcgatgatttccgccgtgcgccgggtgcgtcctaaatcgctactgatgatatgcgtaatgccaagctctttggcacgggttgccacctgcatcgcctgttgctcacctttggcggtcagcgggctgtcagactggccctgaatacgtcgctcggcgttccactgcgtttcaccgtggcggactaggtatacctgtaacatgctttttttccgtatactgctgtaacgttaattttctgagtaatgctgattatgcaccaagttgtctgtgcgaccaccaatcccgctaaaattcaggccattctgcaggcatttcacgagatcttcggcgaaggatcctgccatattgcatccgttgccgtcgagagcggtgtaccggaacagccctttggcagtgaggaaacgcgcgctggcgcacgaaatagggtagccaatgcccgccgtttacttcctgaggctgatttttgggtggcgattgaagctggcatcgatggtgacagcactttcagttgggtggtgatagaaaacgccagccagcgcggcgaggcgcgttcggctactttgccgttgcctgcggtgattctggaaaaagtgcgtgaaggtgaggtgcttggtcccgtgatgtcgcgttataccggtattgatgagattggtcgtaaggaaggggcgatcggcgtgtttaccgccgggaaactcactcgcaccagcgtctatcaccaggcggtgatcctggcgctgagtccgtttcataatgccgtgtatcagccattgcaggcctgattaggcgttcacgccgcatccggcattcggtgcacgatgcctgatgcgccatgtcctatcaggcctacaaaatcaatcgcttttcagcaacacgtcttccagccactggcgcagctcgacgggcgcggctttcagactattagatccacgcgtaatcgtcgcgatgcccgcgccgagttcattttttaactcacgctggctcatttcgccgcgcaacagctcttcgacaatacgcacgcgagtccccaacgcttcgcgctcatctggcgtcagcatcaggtttaacaacggtaaatggagatcgttttggtaggcattcttaagcaggtcgacaaaacgtaaccactcctggtgacgctgttctgccatcgctgctgaatagggtgattgttgggccatagtatgtcgccattgttagcgggggaagcaaaatgcctcccccggttgtactcgctaaagagtacgatagcatatcataaacgtgtggatcagtaacgacgtccccattccgtggcgctcatcaacgtcggtttatcccccatgaaatagcggtagtaagcgtcataagccagcacgtttttcacataaccgcgcgtctcggagaatggaatactctcgacaaatgccactgcgtcgatacgccctgcgctgttgccaagccaggttcgcacccgccctggtccggcgttataagctgctgaggagaaaatacggttattgccaaactgctgataaacatattgcaggtaactggtgccaatgttgatgtttgtttccggatccagcaattgcccagggctgctataaccgggaatagagaacatcttcaccgtatgggtcgcggtaccaggcataatctgcatcaggccgctggcccctaccggtgatttcactttcggattccaggcactctcctgacgggcaatcgccatcgcatagctttgcgggatctccttaccactggtgtagcgtttgaaaagatcgttgtaagccagcgggaatcgctcttccagatgatcccacagcttcccggcgatcgttgcctgaacgctaagatcccaccattggttattgaaagcataccgagccagttgagcctgctctgtttttgacttgctcttcaccagattggcccactcgctacgcgcggtgttatcgagattccagtacatcaactcgcgcacgcgcgccatctccggcccctgagtcagggcgctgtcaacattctgcggcgctttatcaatcttcagctcatactcttcgccgatgcgttgtgcagcaaccatcgggtagaaaccacgctgttgcatgagttgatgcaaaatctcttttgcttcagcttcacgtccgcgttccagcaataaatccgcctgccagtaacgccattcatctttctctttcgcttccataggcagacgcgccagccaggtattcaggccgcgacgatcgccggtgccaagcgccattcgcacacggcgttcaataagcgaagtagattgcgaacgcataatcgcgtcatcgcgccatttcgcctgctcgtcggtgacatcgttgcccatcaaacgccatgcgacaatatcgcgcagctcctgaatctgatcttcattaagctgctgtgcctgagcaagcgacgggatcatcagccgtgcattttcagcatcctgccgcgccacactggcaaacgccaccgccgccatttgacgggtaaaatcggtcgcgccggttgtacgcgcgaaggtcagtaccgtattagggttgttcgccagtgaaatgattgccgaagcgatagtctggtaatcggcaggcatctgccctgccagcactgttaccaggccggtgttacccgctttcatcgccagacggatacgctctaaatacgccagcggatcttgtttacctgacgcacgccagacgctaaataacttgtcacaggcgttaggctggctcttgccggttagccacagctctttcgccccttgccaggcttcttcactctgcccggtgttccatttcgcatagtagtaattacattgcgcttcggtagttccgggcttttccgggctaaaggctaacaagccacgccagtcttcacgccgcgccagttcattgacgaaacgagattgcagcgtgcgagcgggaggaagcgtggggttagcgcgaacaaagttagtgaccgtcaccgccggttgattcatcaggtcatcagtgatctggcggtattccaggtagggataaagtgggtaatctttcagtccaggcatcatttgttcgaccacatccatttgtcgattatcccaggcctgcttgatttgcgcgtaacgactacgctgctcatccagtgagtcggctcgcgccacgctgctgaccgtcagcagacagacaccgacagccaacagccgccaggtaacgtgtttggctttttccacaagcgcatcctctaagtgtcaatacatcaatgcagcgtcatgccgcgtaatagatttatgctaaccagtcattgccgtttacgccacgttacggacacttttttacttttacggggtgatcgactggctgggattagacagggaaacaggctacacttcgcctttgaaaactcatcatcacgataaacatagaggcgaagtccaacgtggctcaattcgtttataccatgcatcgtgtcggcaaagttgttccgccgaaacgtcatattttgaaaaacatctctctgagtttcttccctggggcaaaaattggtgtcctgggtctgaacggcgcgggtaagtccaccctgctgcgcattatggcgggcattgataaagacatcgaaggtgaagcacgtccgcagccagacatcaagattggttatctgccgcaggaaccgcagctgaacccggaacacaccgttcgtgagtccattgaagaagcggtttctgaagtggttaacgccctgaaacgcctggatgaagtgtatgcgctgtatgccgatccggatgccgattttgacaagctggccgctgaacaaggccgtctggaagagatcattcaggctcacgacggtcacaacctgaacgttcagctggagcgtgcggcggatgcgctgcgtctgccggactgggacgcgaaaatcgctaacctttccggtggtgagcgtcgtcgcgtggcgttgtgccgcctgctgctggaaaaaccagacatgctgctgctcgacgaaccgaccaaccacctggatgcggaatccgtagcgtggctggaacgcttcctgcacgacttcgaaggcaccgtggtggcgattacccacgaccgttacttcctcgataacgttgcgggctggatcctcgaacttgaccgcggtgaaggtattccgtgggaaggtaactactcctcctggctggagcagaaagatcagcgtctggcgcaggaagcttcacaagaagcggcgcgtcgtaagtcgatcgagaaagagctggagtgggtacgtcagggaactaaaggccgtcagtcaaaaggtaaagcacgtctggcgcgctttgaagaactcaacagcaccgaatatcagaaacgtaacgaaaccaacgaactgtttattccacctggaccgcgtctgggcgataaagtgctggaagtcagcaacctgcgtaaatcctatggtgatcgtctgctgattgactccctgagcttctcgatcccgaaaggagcgatcgtcgggatcatcggtccgaacggtgcgggtaaatcgacgctgttccgtatgatctctggtcaggaacagccggacagcggcaccatcactttgggtgaaacggtgaaactggcgtcggttgatcagttccgtgactcaatggataacagcaaaaccgtttgggaagaagtttccggcgggctggatatcatgaagatcggcaacaccgagatgccaagccgcgcctacgttggccgctttaactttaaaggggttgatcagggtaaacgcgttggcgaactctccggcggtgagcgcggtcgtctgcatctggcgaagctgctgcaggttggcggcaacatgctgctgctcgacgaaccaaccaacgacctggatatcgaaaccctgcgcgcactggaaaacgccctgctggagttcccgggctgcgcgatggttatctcgcacgaccgttggttcctcgaccgtatcgccacccacattctggattaccaggatgaaggtaaagttgagttcttcgaaggtaactttaccgagtacgaagagtacaagaaacgcacgctgggcgcagacgcgctggagccgaagcgtatcaagtacaagcgtattgcgaagtaatgcgtaaaatgccggatgcggcgcaccagcatcgcatccggtattagttaaatgattaatgggaagcaagttcccggaaaaaggcaggattttctttaattgtggcaagtacttttgcagccaatcccgtaggatttcttcgcttcgattcccagcttttaatggtatccacactggttcccagagcttttgccatctcactttgagaaacgttgagttgctcacgaatagctttaacatccgcaatttcgtagcgggtcacccgtgcaggttcttttaaaccttgtttaatctcgacagcctcttccagagaggttttcaactcatcaaaaaaactcattttatatctcgcctttgagcagtttcgtcaacttctttagttgagctttttccgtatctgtcagactatctttggcatttatcggataggccataatcaaataaataatctcttccgtcgccagaaagtaaattattctgacactgccactttttccctgtgaacccgcagccattcggactttacgcaatccaccagtctgctgaatgagatcacctttatcgggagttccgatgagttctttttgtaattcctttaattcatcatcggttgcaatctgcttgatctgacgcgtaaacattggcgtctctataaatattatcgccttacccattccccctccctggcaggtacattgtacacctaaatggagtactaagtacacttttaaatcagtaatcccactcaacatcttataaagatgattatctttgctcccccatcatctcccgcaccagctccacgcagcgcaggaaacggctgtcgtaatcgtcctcttcaacccgcacgaattcgatattgttctcttccaacatctccaccagcaagttctggaactctttgcgatccaccgaactgccgaggctgcgtaaaccatccgccacccacggcgtgttgttctccagcaggatcaccagatcgaaacggtattcatcaatcaacgcctgcacgaacggatgctcacgcccttcgtactttttgcagaacgcctgggtagtgacaaaatcggtgtcgataaacgccactttattggcatatttcactgcaaaatcaatatattgcgcgtgtcccagcgcgattttatcgtagtcggaatactgcaacgcaatctcatcaccgccaaggtgtgaaaagacataatcgcgaccatattcccatgcactggtagtgttgaagatattggcaagtttgtttaccagggtggatttaccgctcgactcgccgccaaggatcgccacggtacgcacaaagaacggcttaacttccgtaggaatatattcccagtagcggaacgggttttcgcggatctgcgcaccgctgatactcataaaggtacgcttcggatcgatcaacaccgtctcgatccccagatgttccatatactgcggcgcatcggcttcttctgaggtgtagataagatccggctgaatgcctttttcggccataaactttttgatgccgttgctccacacatcccagccgtgtggatacggttccatgccctcttcgttaaaagcatgaatgcggatatttttttgatacttaaaggtctgcaataaccagcgcagacgatccggcacggttggctgctgcgacatggcgctgtcttcgaacaatgcgcggtcgcgggtatcgtcaaaacccataatgatatgcagctcgtcaacctggctacaggcgcgctggataaggtagatatgtccagtatgcagcgggtaaaacttaccgaatacgacaccgatcgttttcttctgccggggaaattcaagtcccaaataacggtgcaatgcctccagcttttgtgcgctggggcttttgattttggcattcagtaactggcttaaataccctttggtcataccgctggcatcagctacctgctgtagcgtgcagccctgttgcttgatggcagttttcaggtaatcaaatgacgacatatctccctccgtatctctcattataagtcgtcgaacacgctaagcgcgtcggagagttttttaacgccaaaaatctgcatcccttccggcgcttttttcggcacgttagctgccggaacaattgcccggcgaaaaccgtgtttcgccgcttctgagattcgttcctggccgctgggcaccgggcggatctcccctgccagcccgacttcaccaaacaccaccagatcctgcggtagcggtctgtcacgcaggctggaaaccatcgccagcagtaacgctaaatcgacactggtttccgtcaccttcacgccaccgaccacgttaacaaacacatcctgatcggccatttgtagaccaccgtgacggtgaagcaccgccagcaggattgccagacggttttgctccagcccgactgccacgcggcgtggattcgccatcatcgagtgatcgacgagcgcctgaatctccaccagcagcggacgcgttccttcccacactaccatcactgagctaccggaggtcacttcatcgccgcgacttaagaaaattgccgaagggttgctgacttcacgcagcccctgctcggtcattgcgaagacacccagctcattcaccgcgccgaagcggtttttatggctgcgtaaggtgcgaaaacgtgagtcggcatcaccatccaaaagcaccgaacagtcgatacagtgttccagcactttagggccagccagcgagccatctttggttacgtgcccgaccatgacaatcgccacaccgcgcgttttggcgaagcgcgtcagataagccgccgtttcacgcacctgcgccacgctgccaggtgatgattgtacatccgccatatgcatcacctggatggagtcaattaccatcagcttcggttgctcttcttcggcaatcaggcagatctgctcgatgctggtttccgacagcatattaagattgtcagtcggcaggccaaggcgatgagcgcgcattgccacctgttgcagcgactcttcgccggtgacatacagcgttttcatctgctgcgccagtttgcacagcgtttgcagcaacagcgtggatttccccgcaccagggttaccgccaatcagaatggcgcttcccggcaccacgccgccgcctaatacgcggtcgaactctttaaatccggtggaaaaacgcggcagctcttcaaggctgatgtcggaaagtttctggacttttgccactccggcgctaccggcatagccactgagacgctcgttacgcgccaccgttggcgacgctgcaagacgcacctcggtgatggtgttccaggcatgacaggcactgcactgcccctgccagcgcggataatcggccccgcattcattacaaacaaaggcgcgttttggagcttttgccacgatgtacctcgttaatgctgtgccgcccgcaggatgacgggcgggcaattacttctgattcaggctgccagagaggatgcagaatacccccatcaggtcagcgtgacggatggtgacttccgtcttttcattcacttttggcttggcatggtaggcaatccccagccctgccgctttgatcatcggcaggtcattggctccatcgccaatcgccacggtctgcgccagcgggatttcatactcctgcgcgaggcgggtcagggttttcgctttatattgcgcgtcaacgatgtcgccgatcacattgccggtaaatttaccgtccatgatctccagttcattggctaccacggctgtcaggcgcagcttgtcgcgcaggtattcagcaaagaaagtaaagccgccggaggcaatcgccactttccagcccagcgtttccagcttgagtaccagctgcgttaagcctggcatcagcggcagattttcacgcacctgttgcagaatattggcgtcagcgcctttcagcgtcgccacgcggctgcgcaggctggcggtaaaatcgagttcgccgcgcatcgcccgttcggttacctccgccaccctctcgcccgttccggccagtttggcaatttcatcaatacattcaatctggatggcggtggaatccatgtccatcaccagcaaccccggcgtgcgcaggtgtgggattttccccagcggcgcgacatccagttgcgcttcatgggccaggcgcgtagcccgcgcagtgagtgaacctgccagacgaatcacctgataatcttccacgcaccaggcggcaacaatcaccatagccgcgcccagtttgctctggtattgggtcagacgttgtttatccagcccacgaccatacagcagccagccgctacgacctgcgtggtaatccagtggcatcacttcatcaccacttaatgaaagaggcagaccaggccataaagagacatcttcaggcaggtcgcaccaggtaatgttaggcattaaggctcctgtaaaatcgttcgaagcagggaaaataacgcatgaggctaccttgtatccattgcttctggcaacattaagtctcaaattttcaaagggtggaagatggctcgcacaaaactgaaatttcggctgcatcgggcagtgattgtcctgttctgtcttgccttgttagtggcgctgatgcagggggcgtcatggtttagtcaaaaccaccagcgacagcgtaatccgcaactggaagaactggcccgcaccctggcgcggcaggtgacgctaaacgttgcaccgctgatgcgtaccgactcaccggatgaaaaacgcattcaggcgatcctcgatcagttaacggatgaaagccgcattctcgacgcaggcgtatatgatgagcaaggcgatcttatcgcccgttctggcgaaagcgtcgacgtgcgcgaccggctggcgctcgacggcaaaaaagcgggcggctattttaaccagcagattgtcgaacccattgcgggtaaaaacggaccgctcggctatctgcgcctgacgctcgacacccatacgctcgccaccgaagcccaacaggtggataacaccactaacattttacgcctgatgttgctgctctcgctggcaatcggcgtagtgctgacccgcacgctgctacagggtaaacgcacccgctggcagcaatcgcccttcctgttaaccgccagtaaaccggtgccggaagaggaagaaagcgagaaaaaagagtgacccattactacaagaaaggaaatcgttatgtccacattacgcctgctcatctctgactcttacgacccgtggtttaacctggcggtagaggagtgtatttttcgccagatgccggctacgcagcgcgttctgtttctctggcgcaatgccgacacggtagtgattggtcgcgcgcagaacccgtggaaagagtgtaatacccggcggatggaagaagataacgtccgcctggcgcggcgcagtagcggtggcggcgcagtgttccacgatctcggcaatacctgttttacctttatggctggcaagccggagtacgataaaaccatctccacgtcgattgtgctcaatgcgctgaacgcgctcggcgtcagcgccgaagcttccgggcgtaacgatctggtggtgaaaaccgccgaaggcgatcgcaaagtctcaggctcggcctatcgcgaaaccaaagatcgtggcttccaccacggcactttgctgctcaattccgaccttagccgcctggcaaactatctcaatccggataaaaagaaactggcggcgaaaggcattacctcagtgcgttcccgcgtgaccaatctgaccgaattgctaccggggatcacccatgagcaggtttgcgaggccataaccgaggcctttttcgcccattatggcgagcgcgtggaagcggaaatcatctccccggacaaaacgccagacttgccaaacttcgccgaaacctttgcccgccagagtagctgggaatggaacttcggtcaggctccggcattctcgcatctgctggatgaacgctttacctggggcggcgtggaactgcatttcgacgttgaaaaaggccatatcacccgcgcccaggtgtttaccgacagtctcaaccccgcgccgctggaagccctcgccgggcgactgcaaggctgtctgtaccgcgcggatatgctgcaacaggagtgcgaagcgctgctggttgacttcccggaacaggaaaaagagctacgggagttgtcagcgtggatggcaggggcggtaaggtaactcgctgattaaaatatccagggaaggaaatatgatcgatctggaaaaccaggaacgggagattatcaatttaatgttcagccagggtatatcctggctaaccgccgtgcgtatcaggcataaactatcacttgctgaagtaagtaaaatgttaggtatctccattaattctctaaaacagatcgaaaagacggaacggcttagttcaaacatcaaaagcaaaatggcaggaatttatggttgtccaccagagttgctgatatgcccttcctgaatgactgctgaacataaatgaatagattcgtgaatagatacttgaatggattttattttctatccatatgaaaaataatagtaaatctataaatcagttgctattgatgaataaatactaaaaagccggagcagtctcccactccggcttcacacgacaatcgcctttcagcaaaacacaattactctttatcgcccagcagaacggattccagcgcgattttgatcatgtcgttgaaggtggtctgacgctcagcggcagtggtctgctcgtgagtgcggatgtggtcagacacggtgcagatggtcagggctttcgcgccaaattctgcagcgacgccgtagataccagccgcttccatttccacgccgaggatgccgtatttttccatcacgtcgaacatttcgccgtccggagagtagaacaggtcagcggagaacaggttaccaacgcgagcatcaacgcccagtgcttttgccgcgtctaccgcgttacgcaccatgtcgaagtcagcgatagcggcaaagtcatggtctttaaaacggatgcggttaactttggaatcggtgcaggcacccataccgataacgacgtcgcgcagttttacgtgcggcagaacagcgccacaggaaccaacgcggataattttcttcacgccgaaatcagtgatcagttctttggtgtagatggagcaggacgggatacccataccgtggcccattacggaaattttgcggcctttgtaagtaccagtgaagcccagcataccgcgaacgttgttcacttcacgggcatcttcaaggaaagtttcagcaatatacttcgcacgcagcgggtcgcctggcatcaaaactacgtcagcaaaatcgcccatttctgcattaatgtgtggagtagccatcgttttatcctttttgtgacatattaaaggcggagtcactgctccgcccaaatccatcagaacatggctttgccatattccatatcagaagtaccaaaatattttgccagagtctggccgatatccgcgaaggtttcacgatgccccagcgaacctggtttcactttcgggccgtaaaccagtaccggaatgtgttcacgcgtgtggtcagtaccggtccaggtcgggtcacaaccgtggtcagcagtgagaatcagaatatcgtcatcgcgcagcaaagacatcagctccggcagacggcggtcgaacagttccagacccgcagcataaccggcgacgtcgcgacggtggccccaggaagagtcgaagtcaacgaagttggtgaagacgatggtgttatcacccgcttctttcatctctttgatggtggcgtcaaacagcgcgtccaggccggtcgctttcacttttttggtgataccgcagttggcgtagatgtctgcaattttaccgaccgaaaccacctggccgtgtttttcatcaaccagtttctgcagcacggtcggtgctggtggctcaacagccaggtcgtgacggttaccagtacgctggaagttaccagctttgtcgccgataaacggacgagcgataacacgaccgatgttgtagccgccgttggtcagctcttcacgggcgatttcgcacagttcgtagagtttatccagaccaaaggtttcttcgtggcaggcaatctggaacacggagtcagcggaggtatagaaaatcggcttgccggttttcatgtgctcttcgcccagttgatccagaatgaccgtaccggaagagtggcagttaccgaggtaacccggcagattagcgcgttcaaccagtttatccagcagctcttgcgggaagctgttttcgtgatcggagaaatatccccactcaaacagaaccgggacaccggcgatttcccagtgaccagacggggtgtctttaccggatgacatttcgtgcgcccatgcgtacgcgccgataacttcagcgttgccatccattcccgccggaatgaaaccggtagaaccttcgtgtgctttcgccagcccaagacgggtcagatttggcagattgagcgggcctttacgaccgtggtcagcttcgcctttggcacaagcttctgcgatatgacccagggtgtcagccccgacgtcaccaaagcgttctgcatcttctgtagcgccgatgccgaatgagtccagcaccataataaatgcacgtttcatatgttctccgtactcagtgcttcaaatttaaatgatcagatcagtataccgttattcgctgatacggcgatagacagttggtgtgctttccggtgctttatcggcaagtttaattgccgctttcaccgctttcgccgcttcctgccagctgttttcgtctttcgcgtggataactgccagcggacgctgaccgtctacctggtcgcccagacgcgccatatcagtaaagccgacgctgtaatcgatggtgtcagatgcctgacggcgtccgccgcccattgcaaccactgccatccccagcgcgcgggtatccatttcactgacaaacccttcggtatcagcatagactgctttcgtcagcatcgctgtcggcagatacttcgcgtagttctcaacgaagtcggtcgggcctttttgtgccgctaccatacgaccaaagacttctgccgctttaccgttgtccagcaccgcctgtaatttcgcgcgcgcttcggcgtcatctttcgccagtttgccggagatcagcatctccacgcacagtgccatcgtgacatcaaacagacgcgggttacgatattcacccgtcaggaactgcaccgcttcacgaacttcaaccgcgttacctgcactggaggccagtacctgattcatatcggtgagcagcgcggtggtgcgcacgccagcgccgttagccacgccaacaatcgcttcggcaagggcttcagagagttcgtaggtcggcataaacgcgccgctacccactttcacgtccatcaccagcgcgtccagaccttccgccagtttcttcgccagaatagaggcggtgatcagcgggattgaatccacggttgcggtaatatcacgggtcgcgtagaaacgtttatccgccggagccagtgagctggtctggccgataatcgccacgccgacgtctttaataatttcgcggaaacggttgtcatccgggaaaatgtcgaagccagggatggattccagtttgtcgagcgtaccgccagtatgaccgaggccgcgaccggagatcatcggaatatagccgccacaggcagcgaccatcggccccaacatcagcgaagtcacatcgccgacaccgccggtcgagtgtttatcaacaatcgggccattcagatacaggcttttccagtcgagaacggttcctgaatctcgcatcgccatggtcagcgagacacgctcaggcattgtcatatcgtggaagaaaatggtcatcgcgagggcggcaatctgcccttcggagatagtgttgtcgcgaatgccgttgataaagaaacgaatttcttcatcactcagcgcatgaccatcacgttttttacgaataatttcttgtgcgagaaacaaggtaacctcccgtggaaaagagacgaggtaatcggggaaccggatgagcatcgctgcatcatccggcaaatcaagccttagtagctgctggcgctcttaccgtcgccgtggcccagagctttcagcaggcttgccagcaagctggaagcaccaaagcggtagtgacgcgcatcagcccagtcagcaccgaacagttcatctgcaatggcgagatatttctgcgcatcttccgcagtacgcacgccgcccgccggtttgaaaccaacggttttttctacgcccatatcgcggatcacttccatcatgatgcgcgcgctttccggcgtcgcattcacagccactttaccggtagaggttttgatgaagtcagcacccgctttgatggagatttcagacgctttacggatcagcgcttcgtctttcagttcgccggtttcaataatcactttcagcagtacgttcgccgcagcgcaagcctctttacaggctttcaccaggtcaaaaccaacctgctcgttacccgccatcagcgcgcggtacgggaacaccacgtcaacttcatcggcaccgtaggcgattgccgcacgggtttctgccagcgcaatgtcgatgtcgtcgttaccgtgtgggaagttagttaccgtagcgatacggatttccggggtgccctgctctttcagcgttttgcgagcaatcgggataaagcgaggatagatacagatagcggcggtattgccgaccggagttttggcctgatgacacagggcgatcactttctcatcggtgtcgtcgtcattcagggtggtcaggtccatcaatttcagtgcacgcaggctgcttgctttcagatcagtcatttcattctcctggcttgtcgccaataaaattcaccttgcgagtttgttagtattctaacatctactccgcaacacacgtcgatgtacatcacaattaaggaaatctacttacaagtttgcatcactgtaatgcgatctggttcaaataattcactttcaaatgaatgcgtcagtggtggcaaacgcatcaggatcaaagtgaacatcacgaaacttcttacaatggcgcatcaccttcggcataaaaggaaaagaagatgcccacttctcatgaaaatgcactgcaacaacgttgccagcaaattgtcaccagcccggtacttagcccggagcagaagcgccattttctggcactggaagcagaaaacaatctgccttacccacagctgcctgccgaagcccgccgcgcgctggatgagggggtaatctgcgatatgtttgaaggtcatgcgccgtacaaaccgcgctatgtcttacccgattacgcccgttttttggccaacggttccgaatggctggagctggaaggcgcaaaagatcttgatgacgcactctctctgctgaccattctttaccaccacgttccttcggtcacatcgatgccggtctacctggggcaactggatgcgttgttgcaaccgtatgttagaattctaacacaagacgagatcgatattcgaataaaacgtttctggcgttacctcgacagaaccctgccagacgcctttatgcatgccaatatcggcccgtctgattcgcccattacccgtgcgatattacgtgcagacgcagagctgaagcaggtttcaccgaacctgacctttatctacgatcctgatatcacccctgatgacctgctgctggaagtggcgaaaaacatctgtgaatgtagcaaaccgcacatcgccaacggtccggtgcatgataaaattttcacaaaagggggctacgggattgtgagctgttacaactcactgccgctggcgggtggtggcagcacgctggtacgcctaaacctgaaagccattgccgagcgcagtgaatcgctggaggacttctttacgcgcactctaccgcactactgccaacagcagatcgccatcatcgatgcgcggtgtgaattcctctatcaacaatcacacttctttgagaatagcttcctggtgaaagaagggctgattaaccctgaacgttttgtgccgatgtttggcatgtatgggctggcggaagcggttaacttgctgtgtgaaaaagaagggattgccgcacgctacggtaaagaggccgccgcaaatgaagtgggttatcgcattagcgcgcaactggcggagtttgtcgccaatacccccgtgaaatatggctggcaaaaacgcgccatgttacacgcacagtcggggataagttccgatatcggcaccacgccgggcgcgcgtttgccgtatggtgatgagccagatccgattacccatctgcaaactgtcgccccgcatcatgcttattattattccggcatcagcgacattctgacgctcgacgaaaccatcaaacgtaatccgcaggcgctggtacagctttgcctcggtgcctttaaagccggaatgcgtgaatttaccgccaatgtcagcggtaacgatctggttcgcgttaccggttatatggtgcgtttgtcggatttagaaaaatatcgcgccgaaggttcacgcaccaacaccacctggctgggagaagaagccgcacgcaacactcgtattctggaacgccagccgcgcgtgataagccatgaacagcagatgcgctttagtcagtaagattatccccttctcctgcgttgacgggccaggcagtcgtctggctctgtttttgcagggctgcaatctgcgctgcaaaaactgtcacaatccgtggacgatggggcgctgtaatgattgcggagagtgcgtgccgcagtgtccgcatcaggcgttgcagattgtcgacggcaaagtggcgtggagcgcggctgtctgcgagcaatgtgatacctgcctgaagatgtgtccgcaacatgctacgccaatggcgcaatccatgagcgtggacgaggtgcttaaccatgtccgcaaagcggttctgtttattgaagggataacggtaagcggcggcgaagccacgacccagttgccgtttgtggtggcgctgtttactgccatcaaaaacgatccgcaactgtgccatctcacctgcctcgtggacagtaacggcatgttgagcgaaaccggctgggaaaaattgctcccggtgtgtgacggcgcaatgctcgatctcaaagcgtgggggagcgaatgtcatcagcaattaaccggacgcgataatcagcagatcaagcgcagcatctgtttgctggcagagcgcggtaagctggcggaactgcgtttgctggtaatccctggccaggtggattatttgcaacatatcgaagaactggcggcgttaatcaagggacttggcgatgttccggtacgcctgaacgcgtttcatgcccacggcgtgtatggcgaggcgcaaagctggccgagcgccacgccggaggatgtggaacaactggctgatgcgttacgggagcgcggggtgagccggttaatatttccggcgctatatttgtgacatgccggatgtggcctacggatcggcacagacctgtaggcatgataagacgcgtcaagcgtcgcatcaggcattgtgcgccagctgccggatgcggcgtgaacgccttatccggcctacggttcggcacagacttgtaggcatgataagacgcgtcagcgtcgcatcaggcattgtgcgccaacggccggatgcggcgtaaacgccttgtccggcctacggcacgttaaacaacgtataggtgttattaagcaacgcttgcgcaatctcatccgccggttccggtcgtaactcgcaaagcacggcaaacacacgggcggcctgttcagggcgattaggctgcccctgaaaaccattgagcggcatatctggtgcgtcggtttccagcaacaacgatgccagcggtaattttgcgatgacatcgcgggttttactggcgcgtggataggtgatagtcccacctacgccaattttgtagcccagttgcacaaaccgttcggcctgttgcaggctgccggaaaaaccatgaaccacgccagtgcacggtaaatcgtggcgtttaagatgcatcgccagtttgtcgtgcgtgcgtcgtgaatgcaggatcaccggcagatcgtagcgtttcgccagtttcagttgttcgtcgagtaaccactgctgcctctcaaattgcggatcgtcgccaaagagatccagaccgatctcccccaccgccaccaccttcgccggatgcctttccagcgcctgctgtagctgatcaagagacacatcgctatgtttttccaacataccaggatgcaagcccaatgcggcatacagcggttgatatttttccgctaacgcctgcacgcgggcaaaattttccgcctctgtcgccggaacaatgatcttgcctacgcccgcttgtgccgcacgttgcaggctggcctcttcatcgccactaaacggcgggaaatcaaaatggcagtgggtgtcgataaaacggcaaatcaagccagatcctcattgttaaatgtcgggtcgttcgcctgcggagcgtcgctcacttcggcaaccagcgtatcgttggcgactggcgcaggcggaataacgatcgactccggcgtcaccaccggcaccagatggcggctcagcggcgctttttcagtcaataatttaccgaccgttgccagaaaataacgcccacataaacgcccaagtttatagtcttcacgcagcgccggaatccgactgccgagcgcaatactatgcaatggcttcggcggataaatttcgaatatccgcagctggcccggtggtttctcaataaattgctgaatctcacgatagctggtttcatgatgctgcaccagattgaccagcggctgcaggctactgtcacccagccagcgttccatgcgtttgaaccactgtggcgtgtagtacatttgtgacggcacagtgcggatgacgaccaacgtttttgctccctgccttgccgcctctttaaccgggatcgcatcactgatcccaccatccaggtagttaataccttccagcgacactccgctacgataaaagccaggtatcgcactggaggcgcgaatcacatccagccagttttgtttagttggcaaaaagtaattcggcgcatagtcatcctgacgacaggcgcacatataaaacgatttgccgctgtcaaataaccgcgctgcggtatccatttgcaacggcatctggcttgcggtggcctccaccagccagtcgagatcgataagatttcctccacggacaaagcgcaatggatcgaaaaattcgcgttttgtggtgtaacgcatgatgactttgcgcgcgtaaccgggctgattgcagatatacgccgagaggttctgcgccccggcagatgtgccgagataaagatcgaaaggattaaactgcgcgcgcataaactcatccagcacgccagccgtgaaaattccacgttgtccgccgccttcgcacaccagagcaatccgtccaggctggaacggccttagcgacaacggcgcaatattaccaagcgttacaggtattcgctgccccacctctgccttcctgtttttgttgtgaaagaatgacaaagtaacgcaatttattattcgctaaaaccgcaaaagccagtccgctggactggctttggataaaattttcttaatggtctgaaatctagggtcgttttcggcccatgaacaaactcaccaagaacagaataatcccgacgacaaagacaattttagctgcgcctgcagcagtaccggccagaccaccaaacccaagtgcggcggcgattaacgcgataaccagaaatatgatgccccaacgaaacataagcgtctcctttaccatagttaatgtcaccgcttgatatgagcgtgaaaatcactcaatgcgatatttttagtgtggtgcacatcgcgcctcccgacaaagttcgggaggtcgaattacgacgaattacttagttttcagatcatttttaacgcttttcacaccatctaccgctttggcgatactttcagcacggtcgctctgtgcctgagaatctacggtaccggagagctggaccacgccatcggtggtttcaactttcacatgacgggaagggacaatgtcatctgccaacagtttggctttgatttcactggtggtggcggtgtcacccgcgtagcccttcacagagccttctttagcgtcgcgaacgtgcagtttgtcgctgacagaggtcacgccctcaacacctttcgccactttcaccgcctcttcggcctgagcctggctttcaacgaaaccgctcagggtcacgactttttgatcggttttgacagagatatcggtgctcttgatgttgtcatgatccaccagggccgccttcactttcgcggtgatggcgctgtcatccatgaaattaccgactttattcatagagctatcgactttttgccctgcgctttcattggtagtctgcgcgttgttttctgcgtaggcagagccggtcgcgacggcagaggtcaacattacagccagcagagttttcgaaatcttcagtcttgtcatagtcatcgatttattcctgtatgtttgctcgtaatttgagcctggcaacacgaggttgcattgctgaatagggagagacttcaccctctacagaagtcaatggtcgccatcacaaaagcgatgggtgatgaataacgaccattacagcctctgaatcagttattaatatcggtagaatgacaatcgacggctttagatactgatatctacgcattgaacggtatttaacgccgtcagaaatgtcattactttgttaaatatagatcacaattttgaaaccgctcgggatatcagctaaaacataagcaaaagtgaatgttttaagaacattccgtaagcggctaataaggaagggaaattgacagggcgcagcggctaccgcgccctggaggctagaattaatgctcgcgggtctggtggaactgaacgtccggataacgttcctgcgccaggcgcagattgaccatgctggtagcgatgtaagcgaggttatcgccgccatcaagcgccagttggctttcgttcttacgcttgaactcttcgaatttcttcgcgtccgcacattctacccagcgggcggtggcaacgttgactgactcatacactgcttcaacgttgtattcgctcttcaggcgcgctaccaccacatcaaactgcagcacaccaaccgcgccaacgatcagatcgttgttggagatcggacggaacacctgcactgccccctcttcggaaagctgtaccagccctttgagcagctgtttttgcttcagcggatctttcaggcggatacgacggaacagttctggcgcgaagttcggaataccggtgaacttcatcatctcaccctgggtaaaggtatcgccgatctgaatggtgccgtgattgtgcaggccgaggatatcgcccggatacgcttcttcaacgtgcgaacggtcgcctgccataaaggtcagcgcgtcggagatcactacatctttcgcggtgcgcacctggcgcagcttcatgcctttttcatatttaccggataccacgcgcataaacgccacgcggtcgcgatgtttcgggtccatgttggcctgaattttaaatacgaagccggtaaatttatcttcgctcgcttctacggtacgggtatcggtctgacgcggcatcggcgcaggcgcccactccaccaggccatccagcatatgatcgacgccgaagttacccagcgcagtaccaaagaataccggggtgatttcgcccgcaaggaacagctctttgtcgaactcattagacgcgcctttcaccagctccagttcgtcacgcagctgctgtgccagatcttcaccaaccgcagcgtcgagatccgggttattcagccctttaacaatgcggacttcctgaatggtgtggcctttaccgctctgatagagataggtttcatctttataaaggtggtaaacgcctttaaacagcttgccgcagccaatcggccaggtgatcggtgcgcagccgattttcagctcgttctcaacttcatcgagcagttccatcgggtcgcggatatcacggtcaagtttgttcataaaggtgaggatcggcgtatcgcgcagacgggtaacttccatcagcttacgggtacgatcttctacaccttttgcggcgtcgataaccatcaggcagcagtccaccgccgtcagggtacgataggtatcttccgagaagtcttcgtgccccggggtatcgagcaagttaaccaggcagtcgtgatacggaaactgcatcacagacgtagtgatggagatcccacgctgcttttccatctccatccagtccgacttagcgtgctggttagagccacggccttttactgtaccggcggtctgaatggcctgtccgaacagcagcaccttctcggtgatggtagtcttaccggcgtccgggtgagaaataatggcaaaggttcttcttttcgctacctctgcggccaaaaggcttgtcataattgttgtctctttgattatgtacaatcatatgtacaaagaaaaattcatgccgctgattgtacattttggaggtatcagagcatagcagaacatgatcagtaggtgtatttgtagccaaagaacatttgtatatgcagcaatctttgctctattgacactgtttattcatacagttaaaaataacactgtatacaaacacagtgtagagggatttttatgcgtattgagatctgcatagccaaagagaaaatgactaaaatgccaaacggtgttgtggatgcgttaaaggaagaattaactcgacgcatcagtaagcgttatgacgatgtagaggtgatcgtaaaagccaccagcaacgatggcctttctgttacgcgcaccgccgataaagattcagctaaaacttttgttcaggaaactctgaaagatacctgggagtctgctgacgagtggtttgttcactaattaacacgtaaaatcagtaacggctggaaatcattcaatactcgcactatcggaggttcaccagccagccgcagcacgttcttgcatacgacgtgcctgcggttttaactccaccagtgcatggataatgattgggctgtgacaggacagcactagcaaaaacaggaaattagcagtctcagcagaacaccgatcatacggtgaggagacaaaaggatacgcaaaagagcgcggttccctagtgacatgaaagcctacaactgtggacttttttgttttttccatctatctccctcaaagagtactcatcttctctttcacagtttccatataccaaccaagcacaatagtctttctgtcataaaaatgaatatctgttatgagcaaggttctgactttggaatttaagaatttatttctgacttttatcataaattagcatcatgttattatgagcgttcaaatattgatttgaacaacgatgatattgtaaggaatatatatgagcttagatactgcagatcaagaccttatgtggccgatggacgttgaatattcattagtcgataattcatccacaaaagcgataatacaagtcggaccaggtattacaacgatggtcgggccaaatggtagtggtaaaacccgagcactgcgtgcaataaaatcaaaattattgagtgaaaaccgaataattggacaaaatagaaaagtacattttctttcggcaggacggtgtagtccatttgaatcctatagatctagctcagattctccttatggcatcaattctagcgatgctgctattggaaacgcgagttacgttgagcaatggtggaattatgaaagtgttactggtgacttaatgatcttagaccagagaccagacctcaaactaaagattgaagcacgcctacagcagttgtttgatcgaagcgttgagctcaagtggtctcaaaatggaatgactattagaataacatccgtcactggcggcgatggctacgcagctaatcacgaagccagcggtatactgcaggttgtctcgttactaactgcaattcataatgacgaaataggtgcattgattatcgatgagccagaaatctccctacacccacagcatcaagcatttctgctcgaagagatggaactggtagccggtgatcctcaaaatccaaagaaaaaaatgataatcatagcgacacattcaccttcaatactaccgctgcgacgaattgaagagttatcaaaaataatctttttcaactccgcacagcaacctccagttcagataccaaaaaatgcagatattctttgcagcacaaaactggccgcattaatagcacgccttagcgctacccatcgaacagctatgttcgctgagcatgttttattagtcgaaggtcctagtgatgaaataatagtaacacaacttgcaagaaagttcggtctccgtctccttgcacgtaatgctcagatacttccagttactggtaagggagagtttatcgaagctgccaaactgtttcgcttgatgaataaacgagttagtttgcttgcagatctcgacgccttagctgacgataataatttagtcaactatttcagtggattaacagaagctagggcgattgcagaccaagtcggaagaacaagtctcgctgatcttgacagagatttgcgtgcagaaattacaaccttcatgactgactttaaggaagaggttgagatagcagctgaaagttatcctaattggtcaagtaaagattctggggctgatagcaaacgtcgcgtgacgttagctcgtattcttactgatccaacaagctttggtacagaagcatcttctcgagccgaaagtctttgtagaaaatacaatgtgcttttgaaggcattaagtaatcttgggtgcttttttttacgtcgaggagcaattgaaaactattacgggacgatagaagaaattggaactggaaaaccagatcgtgctgcactagaagctgctggatttgatgctaaaactcagaaagaacttgcaatgtgttataatgatatttatgatgccttaaatcatacggctccaaatcagtttgtcgatgaagatcgtctccttcgtatgaagctcggtgctatgttgacaccagtgatgcttgaaatgacattgaacagtagcgatcaagaacttgatacactagctagatctaccatcggggttgatgcaacagtattcaaattaacgaataaatctactgagcaacagcttaagcttaaagttgatatagtctcaccattgtttgagcgtacgactttcccatttgaaatctccccatcccaaaacccaattaccattataccggaagtattaccaggaattcaggagtaaaaatttaaaatctatattatcgtaacttttaaagttacaattatattggatattagtgatatggttccattaattaataagagttaaatttagcaatatgaaatttctgatcagggttgctgcaaccctgatcaatcaacatccaattatccaagatatgtctgatgcatcagaaactcctgtttatacctaattgaatatactcccatttttttcatactacctaacagaaatagtgcgcaagtaagttcttagcttattgtacataaagtaagataaaactatgtctacttctggcacatagcacacctaaaacagtagcgtgtaatcatgtaagctcggtgtaaggaggagcaaatcctctcatgcaaaaaatacataaaatcagtaatggctggaaattattcaatacccgaactatcaaaggttcgccagcaagccgcagtattccgccatgacaagttgctgcgactttttatgttgaacggataaatacccagaccagcagacacgccaccaccggcacagcaaaatccatcaggcttgccacataaggcctttgaataagacaaaaggctgcctcatcgctaactttgcaacagtgccggcgcgagcacctgagcgagctgcaaaccgtgttcggtttccggcccttcaccatgagccattaccggcaggccgtccagatgctgaccgagctggcgatgcaaaccgacaaaggcatcgtgctggccagcgccttgatcgggcacctgcggcggcagtcggtcattctgcccgccctcaacgccgtcgagcgggcgagtgccgaggcgatcacccgtgctaaccggcgcatctacgacgccttggccgaaccactggcggacgcgcatcgccgccgcctcgacgatctgctcaagcgccgggacaacggcaagacgacctggttggcttggttgcgccagtctccggccaagccaaattcgcggcatatgctggaacacatcgaacgcctcaaggcatggcaggcactcgatctgcctaccggcatcgagcggctggttcaccagaaccgcctgctcaagattgcccgcgagggcggccagatgacacccgccgacctggccaaattcgagccgcaacggcgctacgccactctcgtggcgctggccaccgagggcatggccaccgtcaccgacgaaatcatcgacctgcacgaccgcatcctgggtaagctgtttaacgctgccaagaataagcatcagcagcagttccaggcgtcaggcaaggccatcaacgccaaggtacgtctgtacgggcgcatcggtcaggcgctgatcgacgccaagcaatcaggccgcgatgcgtttgccgccatcgaggccgtcatgtcctgggattcctttgccgagagcgtcaccgaggcgcagaagctctcgcaacccgatgacttcgatttcctgcatcgcatcggcgagagctacgccaccctgcgccgctatgcaccggaattccttgccgtgctcaagctgcgggccgcgcccgccgccaaaaacgtgcttgatgccattgaggtgctgcgcggcatgaacaccgacaacgcccgcaagctgccagccgatgcaccgaccggcttcatcaagccgcgctggcagaaactggtgatgaccgacgccggcatcgaccggcgctactacgaactgtgcgcgctgtccgagttgaagaactccctgcgctcgggcgacatctgggtgcagggttcacgccagttcaaggacttcgaggactacctggtaccgcccgagaagttcaccagcctcaagcagtccagcgaattgccgctggccgtggccaccgactgcgaacaatatctgcatgagcggctgacgctgctggaagcacaacttgccaccgtcaaccgcatggcggcagccaacgacctgccggatgccatcatcaccgagtcgggcttgaagatcacgccgctggatgcggcggtgcccgacaccgcgcaggcgctgatagaccagacagccatggtcctgccgcacgtcaagatcaccgaactgctgctcgaagtcgatgagtggacgggcttcacccggcacttcacgcacttgaaatcgggcgatctggccaaggacaagaacctgttgttgaccacgatcctggccgacgcgatcaacctgggcctgaccaagatggccgagtcctgccccggcacgacctacgcgaagctcgcttggctgcaagcctggcatacccgcgacgaaacgtactcgacagcgttggctgaactggtcaacgctcagtttcggcatccctttgccgggcactggggcgatggcaccacatcatcatcggacggacagaatttccgaaccgctagcaaggcaaagagcacggggcacatcaacccaaaatatggcagcagcccaggacggactttctacacccacatctccgaccaatacgcgccattccacaccaaggtggtcaatgtcggcctgcgcgactcaacctacgtgctcgacggcctgctgtaccacgaatccgacctgcggatcgaggagcactacaccgacacggcgggcttcaccgatcacgtcttcgccctgatgcacctcttgggcttccgcttcgcgccgcgcatccgcgacctgggcgacaccaagctctacatcccgaagggcgatgccgcctatgacgcgctcaagccgatgatcggcggcacgctcaacatcaagcacgtccgcgcccattgggacgaaatcctgcggctggccacctcgatcaagcagggcacggtgacggcctcgctgatgctcaggaaactcggcagctacccgcgccagaacggcttggccgtcgcgctgcgcgagttgggccgcatcgagcgcacgctgttcatcctcgactggctgcaaagcgtcgagctacgccgccgcgtgcatgccgggctgaacaagggcgaggcgcgcaatgcgctggcccgtgccgtgttcttcaaccgccttggtgaaatccgtgaccgcagtttcgagcagcagcgctaccgggccagcggcctcaacctggtgacggcggccatcgtgctgtggaacacggtctacctggagcgtgcggcgcatgcgttgcgcggcaatggtcatgccgtcgatgactcgctattgcagtacctgtcgccactcggctgggagcacatcaacctgaccggtgattacctatggcgcagcagcgccaagatcggcgcggggaagttcaggccgctacggcctctgcaaccggcttagcgtgctttattttccgttttctgagacgacccctattatggcgaaggtatcattcaggaagcgttgatgaaggattatctctgtaaaaagttattcaaccggctttccggtaccctggtgatcagagcgcgctgcggcaataacattactggcctggcatgttgcaatattctttatccctcgccccgatacagcggtcagctgcatattaaagagctgtatgtttctcagtgcgatcgaaataagggcacgggtaaagcgataatgcgctttatagcccggcttgcgcttgaacaggaatgccttagccttagctggaacgctgaaaaatccaaccccggcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggtacgcaccagaaaatcattgatatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccgttttatctataacaatttctttgctgaatctttcttttacaatttcggctgagcgtagaccgaatttttttcttatttccatgttatctctaagatattcaattttctccgcaatctcattagcgctatgtgtttttagtacacatccattgaaattatctttaattatggctttacagccgggtacatttccgacaatgcaacttcggcccatagcacacgcttcaatgattattcttggcacgccttctgaatatttagttggcaaaatcacgacatggctatttctgattaaattttggatgtcatctcttcgacctaaccaaatgatttttccttctttttcccattgcaaaatttgatctaattcaattctatccggatctttgtcatcgagaattcccgcaacgtataaggttgtgttattttcattttgtttaaccttaccgatggcctcgactacttcaccgagcccctttgaccatagcaaacggctggcaaataataccgagaaattattctgagttggttctggctgataactaaagcgaaacctgtctaccccggctccttcaatgatgtggatgttattttcatcaaatttaatatatttactcagctcagcaaagtcagcattatgctcaaatattacttgcgctgggctttttgctgatagcaaaagactataaattgacagtactgagttgaaaatgaatttattcaaccaacctcgtttattgccaaacaatctccctaatcccacaaagctcacgacaaaagggatgcctgcaacccgggcatacaatccaccaaaaaggattggttttatagtaattagatgaataagatcgggtttaatttgcttacagatctttctaaatgcagtgaatattgaaatgtttttaaacacatttttagaaaatctgttaagctcaatatcccaacattttataccttttttttccaggttatttttgatggcgtcatcagcaaaattacttacaagatgaacttcataccctttgctaattgccgcttctgaccggtccaaccaatgcagttcgaagtaccacgctgcattgacaaaatacactatcctcataccattcctcaacaactcgcgagatggtcaatcacggcttactacatgtaatgtaggcacgctaccgcccttggctctggctgccaaagggcgaaactcttgttttttgtcaggagtattgacggccaggctactgaccgctgcaactaccctaagcctaacactcccattgcagcgtagtattactcaagacaacgggttgtattttgagtgtaataatcttagagcctatcccaataggattttattccagacaatgacgccgcaggtaagatacagcattgccacataattttcgactttcttctcccagagagtcaacacccgacggaagcgattcatccaactgtgcgttctctccacgacccagcggtgagctttaaaatccgtgcttttgatggcttccgactcctctttccttgactggatatgaggttcgtaacggcggtttttcagacaggcctccagccattcggcttcatagcctttgtccatacagaggtggagccttctgccaggcctgcccgtctgaagggcatcgagagtatcagcaaccagctttatgtcgtgggtatttgcacctgcgacaaccaatgagaggggaagcccgttcgcatcggtcatcaggctacgttttacgccctgtttccctcgttctgtggggttccgtcctgttttttgagccagccagcggtgacttcgtcatacagccatccatcgacagccatgaccagtcgatggcatccaactgctcacaggccagcaacccgttttgccagaaccgttcaaaaactcctgcatcccgccactcctggaagcggcggtgagcagagcttgacgagcatatcccggtggcattcagggcattccactggcaacccgttctgagcacaaagagaatggcgttcattgcggcacgattattaacccgcctgcgatgcgtacccagcggatggtgagttttgtgttccgggagcaacggagccattttttcccagagttcatcgctgatctgccacttgttacctgccatacttccctcagaaattgtcattacttattaactgacaattccttttgggataggttcttaataagatgaataaaaaaacaagcatcatggcagtcagctcctgacaggctttgttgaataaatcagagtcagccgaagagggggccagcagtacacccgttatgcgatccggacactatgcggcatacccaacaacgtcatccggtttagcgctttaaccatcgccatcgcttcgcccacctgcgcgtccccacctgcgcatcgtagtctcgcaggctcaagtgtccgcccagcaaggttttgatacggaacatcgccgtttctgccacggaacgtcggtggtagcctactttcttttttcatacatcattgccaccgctcagatgctgattagccaccgcatggttacgttcatggtatctgcccggccagtattgcgccccgtttcgtggagggataagtggcctgatttttttcctcagcaacgcatcatgacagttgcgcgtgtcataagcgccgtctgctgaagcttctcttatttttcggtgggtctggttaatcagccccggcagtgcctgcgcatctgtcgtaccgctgagcgataaatcggcacagattatctcatgcgtcacaccgtctgcagccagatgaagtttgcgccatactctgcgcctgtcagccccatgttgcctgactttccattcgccttccccgaagaccttcaggccagtagcatcgataaccagatgcgagatttcaccccgggttggcgtttttatgctgatgttaacgctctttgcatgtttgctgaccagagagtagtccgggcaacgcagcggcagagccatcagcgtaaaaatcgagtcaacgaagccctgtaatgcccggagtggcagattaaacacgcgcttcatcatcagaaccgtggtgatcgccatataggtgtagtggagagtccgaccacgaccttcaggctttgcgcagtcagtccatgcagcaatagcagattcatcaagccagatcgtcagcgaaccacgctgtctgagtgccttgttgtaagctgaccagttggtgattttaaacttttgctttgccatggtgacacgatgggtaatgctgccaacttactgatttagtgtatgatggtgattttaaggtgcttgcgtggcttccatttccatcagatgtccttcctgctccgctactgaaggcgtggtgcgtaacggcaaaagcaccaccggacatcagcgctatctctgctctcactgccgtaaaacatggcaactacagttcacttacaccgcctctcagcccggtacgcaccagaaaatcattgatatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacgactgggacggaagtcgctgtcgttctcaaaatcggtggagctgcatgacaaagtcatcgggcattatctgaacataaaacactatcaataagttggagtcattaccgaagacgcaaaaaaaataatataataacaaaaatcctccagccttgtaggccagaggataaaatacttaattgaggaaaatatcagggaaaagtatttctgatttaactttcccggctggagagtgaatcaatgtaatcagcgtaccattgcatcatttcacggcggccatcgagatacagggcatgattataggtacccctgatggaatttttatccacatgagctaactgcatttcaatccaggcggaattaaagccttgttcatgcagaattgtactcatggtgtgtctgaaaccgtgccctgtgagtcttcccttatatccaagtaattcaattacttggttaatgctttccttactaattggtttgcggggatcatttctaccgataaagactaggggatgatgttttgagattggttcaagctgcttaaatagcataatgacctgctcagagagcggcacaatatgaggtcgcttcatcttcattacttctgccgggatctcccacaattttgtctcaaaatcgatatcttcccagcgtgcaaaacgcagttcttgtgttcgtacgccggttaacataatgatctgagtagctgtcttagtgattatacttccggtataacccgccagatcgttgaggaagtggggaagttcattagcagtaagaaagggaaaatgtacttttttcggtgtagctaaagcactggcaagatcgggggctgggttatagtctgcccggccagtaacaattgcatagcggaacacctcaccacagcgctggcggaccttgcgcattttctccagagctccacgtttttccattttacgtagtgcttccagtaactccattggtttgatttcggcaatagggcgcttgccaatgtagggaaaaatgtctttttcaaaggtatcaatgatttcatcacgatagcgtaatgaccaccgatcagcttttgactggtgccattcgcgagcaatagcctcgaacgtatttttcagactcatttgctgcgcgattttttcttccttttttgcctcccctggatcgcctccagcagcgaggagtttcctggcttcactgcgtttctcgcgagcatcggctaacgttacatcggggtatacgccaatagaaagcatcttttctttaccagcaaagcggtacttcatgcgccagtatttagaaccattagtgttaatcagtagatacataccgccgccatcagcaagcttatagggtttgtctttgggttttgcggttttcactttgatatcggttaatgccatgacatcctccggcttttgatgaattcatcttcctgagggggatttctgccagtaactaacctgatacccccaatacaccccttgtataacaaagatattgttaaaagccgttgttatgtatcatatttttcctattatgggggtgcttgtatttcaataggaaataacaccccctaaagtacccccaaaagaaacttgatatggggtgaagtaggttgacctcaggatacaaataaatactgatatacaagggattagaagagatttattgacattgggagagttcagaagaggtaaactggcggaagatcacaggagtcgaacctgcccgggaccgctggcggccccaactggatttgaagtccagccgcctcaccggagacgacgatcttccgcgcctcgattgctacatggaggcggggcgcattatagctacttccttgagtttctacatcccccagatcagttttttccgcctaatacacgcagcgtattatcacgaaagcattatagttcatataaaactcatattttacaatgatatatgagcgaaattaacgctaccacgatcacataaaacaagaatcataaattaataaccagatatcggaatattcgctctcgcagggatggtttacaaaatgcgttatcggtctcagcacccctatagcatcaaggaaaagcagatgaagagtgaagtgttgtccgttaaagagaaaattggctatggcatgggagacgccgccagccacattattttcgataacgtaatgttatatatgatgttcttttataccgatatttttggcattcctgccggatttgtcggaaccatgtttttggtcgcgcgtgcactggatgcgatttccgatccttgcatggggttgttggccgatcgaacgcgctctcgctggggtaaatttcggccgtgggtactgtttggcgcactgccattcgggatcgtctgtgtattggcctatagcacgccagatctcagtatgaacggaaaaatgatttatgcagcaattacttacaccctacttaccttactttataccatcgtcaatatcccttactgcgcattgggtggtgtaatcaccaatgacccgactcagcgtatctcgctgcaatcctggcgttttgtgctggcgaccgcgggaggcatgctctctactgttctgatgatgccactggttaatttaattggtggtgataataaaccactcggtttccagggcggtatcgcggtcctttccgtggtggcatttatgatgctggcattctgtttcttcaccactaaagaacgcgttgaagcaccacctacaacgacgtctatgcgggatgatttacgtgatatctggcaaaacgaccagtggcgtattgtcggtttcctgacaattttcaatatcctggcggtgtgcgtacgcggtggggcgatgatgtattacgtcacatggattttgggtacgccggaagtgtttgtcgcttttctcaccacttattgcgtgggtaacctgattggctccgcactggcaaaaccgctgaccgactggaaatgtaaagtcactatcttctggtggacgaacgccctgctggcagtgattagcctcgcgatgttctttgttcctatgcaggccagcatcaccatgtttgtcttcatcttcgtgattggtgtgttgcatcaactggtgacacctatccagtgggtaatgatgtccgataccgtcgactacggcgagtggtgtaatggtaaacgcctgaccgggatcagttttgctggcacgctgtttgtgctcaaactggggttggccttcggtggtgcccttatcggctggatgctggcttatggcggatatgatgcggcagaaaaagcgcagaacagcgtcacaattagcatcattatcgcgctattcacgattgttccggcgatctgttacttgctgagcgcgattatcgctaaacgctactactcgctcacgacgcacaatctgaaaaccgttatggaacagctggcgcagggcaaacgccgttgccagcaacaattcacctctcaagaagtgcagaactaaggaacggcaatgaaaattagcgacggaaactggttgattcaacctggcctcaatttgattcacccgcttcagatgttcgaggttgaacagcagggtaatgaaatggtggtctatgctgcccctcgtgatgtgcgtgaacgtacctggcagcttgatacgcctttatttacgctgcgctttttctccccacaggaaggtattgtcggtgtacggattgagcattttcagggggcgctgaataacggtcctcattacccgctcaatattttgcaggacgtgaaggtcactatcgaaaacacagaacgttacgctgagtttaaaagtggcaacttaagtgcgcgtgtcagcaaaggtgagttctggtcactggattttctgcgcaacggcgaacgtattaccggtagtcaggtgaaaaataacggctacgtgcaggacacgaataatcaacgaaattatatgtttgagcggctggatcttggcgttggcgaaacagtttacggcctgggagagcgctttactgccctggtgcgcaatggtcagacggtagaaacctggaaccgggacggcggcacaagtactgaacaggcgtataaaaatatcccgttttatatgactaaccgtggttatggggtactggtcaatcatcctcaatgcgtctcttttgaagtgggatcggagaaagtctccaaagtacagttcagcgttgagagtgaatatctcgaatactttgttatcgacggcccgacgccgaaagcggtacttgatcgttatacccgttttactggccgtccggcgctgccgcccgcgtggtccttcggtctgtggctaaccacttcatttaccaccaactacgacgaagcgacggtaaacagctttatcgatggtatggcggaacgcaatctgccgctgcatgttttccactttgactgtttctggatgaaagccttccagtggtgcgattttgagtgggacccgctgacttttccggacccggaagggatgatccgccgtctgaaagcgaaagggctgaaaatctgcgtctggattaacccctatattgggcaaaaatcccccgtctttaaagagttacaagagaaaggttatttactcaaacgcccggacggttcgctgtggcagtgggataaatggcagccaggtctggcgatttatgactttaccaatccggatgcctgcaaatggtacgccgacaaactgaaaggtctggtcgcgatgggcgttgattgctttaagaccgactttggcgaacgtattccaaccgatgttcagtggtttgatggttccgatccgcagaaaatgcataaccattatgcgtacatctacaacgaactggtgtggaacgtgctcaaggacaccgttggtgaggaagaagccgtcttgtttgcccgctcggcctccgttggtgcgcagaaatttccggtacactggggtggcgactgttacgctaactacgaatcaatggcggaaagcctgcgcggtggtttgtctattggcctttcaggttttggcttctggagccacgatatcggcggctttgaaaataccgctccggcgcacgtttacaaacgctggtgcgcgtttggtttgctttccagccatagccgtttacatggcagcaaatcttatcgtgtgccgtgggcctacgatgatgagtcctgtgatgtggtgcgcttcttcacgcaactgaaatgccgcatgatgccgtatctgtatcgtgaagctgcacgtgcaaatgcgcggggtacgccgatgatgcgggccatgatgatggagttcccggacgatccggcttgtgattaccttgaccgtcaatacatgttaggcgacaacgtgatggttgcgcctgtgttcactgaagcgggcgatgtgcagttctacttgccggaaggtcgctggacacatctgtggcacaacgatgaactcgatggtagtcgctggcataaacagcagcacggcttcctgagtctgcctgtttatgtgcgtgataacaccctactggcgctgggcaacaacgatcaacgtcccgattacgcgtggcacgaaggtacggcattccacctctttaatctgcaagacgggcatgaagccgtctgtgaagtgcccgatgctgacggttcggtgatctttactttaaaagcagcacgtactggcaacacgattactgtgactggtacgggcgaggcgaagaactggacactgtgcttgcgcaatattgtgaaagtaaatggtctgcaaggcggttcgcaggctgaaagtgagcagggactggtggtgactcctcaagggaatgcgctgacaattacgttgtaatctattgaagaatgccggatacgaatggttttgtgtcgtatccggtaaataatctcacatctggtaataaatatttcttccatcgtatttgcgagcatgatcacgattattcatcacgaaaatgtgatctgtgctgaaaaatatcccttaaccgccttgctttgttttatcactgtccggattacggacagattttagtattgttgtgaaattattctgctttatatttaccctcagagatggcaactgaagctcttccatatggggcttcttaatctgtgataagggtaaaaaatgcaaatgattacctcgcgacaaaacagattattacgattccttttacctcgaagggaatatacgactattgttacgattgccggctatttaaatgtttcggaaaaaactattcaacgtgatttacgtttacttgagcaatggctgggacaatggagaataaatgttgagaagcgtgctggcgcgggtgtgatgttaagcgcggagaatattgctgatttgctgcatcttgatcatttgttggtggcagaatgtgaagagattgatggtgtaatgaataatgccaggcgcgttaaaatagcgtcgcagttattaagtgaaacaccgaatgaaacgtcgatcagtaaattgtcagaacgctactttatcagcggagcctctattgttaatgacctgagagtaattgagtcctggcttgcgccgttggggttatcgttgatccgcagtccaagtggtacgcatattgaaggtagtgaagggcaagtccgacaggcaatggcattactgattaacggcattattaaccataatgagccgcaaggtgtcgtgtattcacgtctggatcccggaagctataaagcattagtccattattttggagaagaagaggtgttatttgtccagtcattgttactggatatggaaaatgaattaagttggtctttgggagaaccttattacgttaacatttttactcacatccttattatgatgtatcgcaacacgcacgggaatgcgttatcaagagaagaagatcaaaccagacaatatgatgaaaatatctttaatgttgccagtcagatgattcataagatagaacaacgaattgcacatacattgcccgatgatgaagtctggtttatttatcaatatatcatttcatcaggtgtggcgattgatggacaaaaagatgttagcattatttcacatatgcaggccagcaatgaagcgcgtctgattacctggcgtttaattacggtattcagtgacatcgtggactgcgattttagtgaagacagcgcattatatgatggcttattggtgcatattaagccgctgattaaccgtctaaattatcgcattcatatccgtaatccattgctggaagatattaaagcagaattagcggatgtctggcggttgacgcaatatgtggtgaatcaggtatttaaaacctggggtgagaatgcagtgagcgaggatgaagtgggttacctgaccgttcattttcaggctgcgatggagcggcaaattgcccgtaaacgtgtattactggtctgttcaaccggaatcggaacttcgcatctactgaaaagccgtattctgcgagcatttcctgaatggacgattgttgatgttatttcagcagcgaatttatcacaggttttgcctgacaatatcgaactgattatttcgaccattaatttgcctacagtcactatgccggtcgcttatgttaccgctttttttaatgatgccgatattaagcgggtcactgaaatggtgattacggaaaaattacatcatgcgacgtctcgggtcgttgaaatttaatgtcagaattttatgaggtatgacgaatggacataacaaaaatcctgaatacgaatcgcgttattttagatatgcaagcaacgaataaagcggaggcgattgaagaattaactaatcttctcaaaaaagatggtgcgatcgattgtcgggaaacctttattaaagatgtctggcagcgcgaagcggaaggctcgactggttttgaaaatcatattgcgatcccgcatggtaaatcttctgcggtaattaatactacgctggcaattggccgtacccgccaggatattccctgggaaacgctggatggcagtagcgtgcgctgtattattttatttgcggtacgtcttgaagatcaaaataccacccatatccgtttactttcccaggtcgcgggcgcgctggcggatgatgacatcatagaacaattgttagttgagacgagtccgcaaaaaatcattgatctctttagtcagtatgcacaatccgatgtctgctaaataacaggaagtatgtcatgaatattgtctgtgttgccgcctgtacggcgggtattgctcatacctatattgctcgtgaaaagttaatcaaaggagcaaaagctctgggccataccattaaagttgaaacccagggaaccattggtacagaaaatgaattacaggcggcagatatctctgctgctgacgtcgtgattcttgctgtagatgtgaaaataaaaggagaagaacgcttcaccaataaacgtattgtgcgagtaaagacagagatcgtcattaaatcgcccgttcaatttcttgaaaaggtcgaaaaatcactgggaaacaaatgatccttatactggagggatcttaatatgaaagaaaataaaattccggtttcacaggaaattaaaaaacatttattaaccggcatctcgtggatgataccccttattgtggccgccgggatatgtattgcgttggggcaagttcttggcggtacagatgttggtgaaaaaacaggaacaatcccgtggatgcttaatcagattggcggctggggaatggggctgattgtgccgctgattagcgcggcaattgcctattctattgccgatcgtcccggatttgccccaggcctgattgtcggctttctctgcgggcaaatccataccggatttattggcggtatgttgggtggtttcctggtgggctacaccattttgctacttaaacgctatatccgcctgccgcagtcgatgcaaggactcatgccaatcatggtgttgccggtattaagcaccattatcggtgggctgttaatgatgacgctgattggtaaacccatcgcctggttacaagaagcactgattcatttgctcgagtcgatgcagggcggatcgcgcttcctgatgggggccatacttggcgcgatggcaaccttcgatttcggtggtccggtcaacaaaaccatgtcgctgttttccgatggcttgctggtcagtggcgtctacggaccagaagccgtgaaatttgtcggctcaatcatccctccgtttggcatcacactttcgttcttactgacacgccataaatacacccgtgcggagcgcgaggcgctgaaagccgcgtttccgatggggatctgcatgatcactgaaggagtcattccgatcgccgcgcgtgacctgctgcgagtagtgggatcttgtgtggtggcatcggcggtcgcgggcggcttaatcatggtgtggggcgtggagagtccggttccgcatggcggcatgtttgttgtgcctctgttcacccatcctctgctgttttgcctggcgctgggtataggcacggtgatttgtggcgtgatgctttcactctggaagaaaccggtaacggaacgcgacgaagagtttgacgaactgagcgatcaaaagctgaaagatgaagagatcactttcaccctcgaataaccggaggccctatgtttgccgatatgaaaagtatggtgatgaaagcctggcatgaacattacgccttgctggcgatcaactgtatgaatctggaaagtgctcacgcagctatccgcgtggcggagaagaatcgcgctccgatcattctcaatctctatcaggggcatctggcgcattttcctgcacccgtcgcggcggcagtggttaaaacgctcgcggaatctgcctcagtaccggtcactctggcgcttgatcatggcaaaaatccggactgtattcgtcaggcgtttcgtgctggtttcagcggattaatgattgatgcttctgcttttcccctggaggaaaacgtgcgccagaccagggcggtggtggaactcgccgccagcgcgcagctctgcgtggaaggcgaactgggccatctggcagatgcgccgcgttacgaccaggccgccaatgcagacctgatgacgcaacccactgatgtggaaccgtttatcgcgcagacaggcattgatctactggccgtctcggtaggcacggcgcacggcatgtacgcgcctggtgttgtacctgctattgattttcagcgtctggcggagattttccactgctcgagcgtgcctctggcattacatggcggtagcggtacgccgttcgatcagctccagctctgtacgacgctgggggtagcaaaaatcaacgtgggggcggccatttttgaacgggggaaatccgcgctcctgcataccctctgtcacgatatatccattgaactggtggacgcgctgaaagctatggaactggccttcgaagaagcgattacaccgtatttacaggcgagcggcgctatcggcaaagcctgattcattttctgtcatggcctttatgccagtgcaataacgcaccggcagggcggactacacgctgaaactggagatttaacatgttagtttcgatgaaagaattactgcaacctacccgccagcacggctttgccattggcgcatttaatgtggcggataactgtttccttcgcgcagtcgtggatgaagcagaagcgacaaatactccggcgattattgccatccatcccagcgaacatgattttgtgggcgatgcctttttcgctcacgttcgcgaaattacccagcgtagtccggtcccgtttgtactgcacctcgatcatggtgcctctgtagagcatgttttgcgtgcgattcgctgcggatttacctcagtaatgatcgacggttcgctgctgccgtatgaagaaaacgtggcgctgaccgcagaagtggttcgcctcgctcacgcggttggcgtgtcggttgagggtgaactgggaaccatcggacaaacaggaacgtcggtagaaggtggtgtttcacaagtgacctacacagatccggcgcaggccgccgattttattgctcgtacaggtgccgacacactggctgtggcgattggtacagcgcatggcatctatccaaaagggatgcagccgaagctgcaaatgaacattttgcgcgacattgccggacgtattgatattccgctggtgctacacggtggttcggcaaacccggacgcggagattgctgaatcagttacgctcggcgtcggcaaaatcaatatctccagcgatatgaaatacgcctatttccagaaagtgcgtgaaattctcgctaaagagagctggtgggacccgaacgtcatctatccggatgcgattaacgcggcgcgggaagtcattcgccacaaaatgaaactgttcggttcgttcggtaaagcatcactgtactaagccagaagggcggggtgacccgccttttacgcaacaaggaacgagatatgcactatctggggttggatattggtgggaccaaaatcgccgccgttgtcatggatgcgcatggctgggagattcgccgttaccgctgcccgacgcaaaagtcaacatatcaacaatttgtctcatgcgttgtggcgcttatcgagcagattaggcgggacgttcaacgaccgatgctgacagggatcgccttacccggcagtatctcgccactcactggcctgattaaaaacgcgaatattcaggtgattaacggtcatgcgttacaggctgatttgcagcaattgcttgggcaacgggtggtgatagccaatgatggtaactgtttcgcgctatcagaagcttgcgacggtgccgggcaagattatgacgtggtatttggtattacgcttggtacgggctgcggcggtggcattgccatcaagcaacgaccgtttataggggcctggggaaatgctgccgaatgcggtcatatcacgttgccaggctatacggagcaggaagatggtccatcagtcagttgctattgcggcaaacacaactgcgtggagtcgtttgtttccggcagcggttttagtgaacgctatcaacagatgactggtaacttgctcacttctgcggcgattgtcaccctggcacaacgtggtgatgcttgtgccatgcagcaggtggcacgttttcgccaacagcttgcccgcacgctggcaaccatcgttaatgttgttgaccctggcgtgattgtgatcggcggcgggctttcgaatgtggaactgcttatcaccgatctgaacgcagaagtcgctccactggttttcaccgatcaattcaccactcccattgtaaaagcacagcacggcgacagtagcggaatgcgtggcgctgcctggcttgctatgcgcaacggagaagccaatgaaacgttcacaaattaattatgttattgataaagcacatgccattgcgcagaccttccgcgtttgtttgccagagttcgcctattttacggtggatgactggctgcagcgggaacgggataactggcaagaagtggtcgacttacagctcggttgggatatcaccgattttggtcgtggtgatttcaaccaaacgggactaacactgctaacgatgcgcaacggcgcgctggggtcggcggcatatccaaaaccgtatgctgagaaaatgttgcagatccaacaagatcagcagactccctggcattttcacacccacaaaatggaagatatcctcaatcggggcggtggagacttatgcatgcagttggcctgggccaacgaagccaatctctgtgatgatcaacgagtcattaccgtgagtgttgatggtcagcggcgtaccatgaaacctggtgaaacgctggtgctaaagccggggcagggcatttgcctgccaccgcgtctgtatcatcgcttctgggcggaaaaagcgtttgttctcggctgggaaatctcgatggtaaatgatgaccaacacgataattattttcttgagccgggaggacgttttccggcgatagaagaagatgaaccggtgaaatggttattgtgcagtgagtatggaattttgcgctaataacggggaacgctagcgctgatatccgctagcgtccttatttttactgcaccggctccgtcgacgtaacttcaccactggaaactacgcccgcattcatggtttgagtcacttgctgctttgcggcattcacggcatgcaattgcccgctaaccgtaggtttcagcgggacattgacctgaatatcgccactggcggtaagctgaatattgccgtcgccagtcaacggtaattcaggccatccccaatgttgcaaaatattcaccggcacaccgcgtccattcaggctgatatgggtctgacgttgtggcgtttgtgaaacactggcggtggcttccagaatgcctttttcagtaaatgcactcagttcgctgatattcaccgtgctgctgttggcagttagcgccagcgacggacgacggacatcaacacgattaaacgttgcggcggcggcattcagattcgccgagccactccagacgccccatttatgatcggtaaccagcgtcagattggcaccgtaaccatcgagcgcggtgagctgccacgggaagtcagggtcgatatcaatgatcagattgcggctggcgctaaatctcttcagttgcaggctgtttaaccaaccgggtgtcgtttccatccacaactgttgccagttttttggcaaggtatattccagtccggcaattgccgcatcatcgaggatcagcgttttcccgtcgcgttgccagtttcctgacgttctgaccatacccccttcccagcggctggtgaactggcgcagtgctacgctctgcggggaaaattctgcgtttataatcggatcaaataaatgcagcgagccataaataaactcgctggcgttcatcgacagtttgccttcctgtgtctgccagtcatctttactgaaggtcatgttgcgcaagctgagatcgaggtcggtcaccgcccagtccggaccttgcaaacgagcatcgatgacttccaggcgaccaatctgcaacgacgggacagagcgtaatggtgcaaagaagtcggttagcgatttttcgctttgtagacggatatccgccatgcgcaggttttccacttgccagctgccgtcagcgttacgctgcgcgtttccggttaatgtcccgcgggcgatgtcggcacccaggttagtcagcgtaacgcgatcgttatcaatactgccttcaatcagtacattggttgcaggaacatcattgagcgaaagcgatccggcactaaactgaatctgcgccttcgtacccagcactttaccggcttctggtgaccacggaaccacgccgccatttacccgctgcgcgctcagtttccattcgctattcgggctattaaacgccatatcacgcagttgcagacgatcggctttgaacggtagcggcgcggtctggtcggtgagattcagcgtcccgttttccagcaggatggtatcgacatggcgtggttcggtcagttgccgactgcttagcgcaatgtcgacactttttgctaccagggtcgcgggctggccatcacggccaaacgtgacgttctccagcacgatatgagatggcgcggaaaaacggtgatccatcgccccgaaggccagatgatagtcgctattctcggaaacccatgcgctgatatgttctgctccccagcgggtttgcagaagaaaatagaggccagcgatcaacactaacagagcgatgaaaatgtagagaagcagcttcccaataaatttcatggtcttccatcccgtgaaatgcacataagggagttatgcacgatttacgcgcaatcctcaaggcgggaatggtgaaagaggtgagactgcggcggtaattatcttaccgccgccagtgaattactgtttttctggtgggaaaatcagattcagcacgatggcagtaataccgcccgcggcaatcccggaggagagcaggtttttcagccattcaggggcaaactgcaaaatcagcggctgctgagacacgcccagaccgaccgccagcgacagcgcgataatcagaatcgcccggcggttcagcggctcacgagaaacgatacgcacaccggaggcggcgatggtgccaaacattacaagcgttgcgccgcccagaaccggttctggaatgtgttgtacaaaaccgctcactgccgggaacagacccagcacgatcaacatcagcgcgacgacaaaaccgacatagcggctggcaacaccggttaactggatcaccccgttgttctgcccgaagcaggagttcgggaaggtattaaataccgccgagacaaacgagttcaggccgtttgccagcacgccgcctttcagacgtttcatgtacagcggaccggaaaccggctgttcggaaacgtcagaggtcgccgtgatatcgccaatggtttccagcgaagtgatcataaagaccagcatcagcggcagcagcagactccattcaatgccaagaccgtaatagagcggcgttggcaccataatcagttcttgcgtcatcggttcgttgctttctggcaacatgcccataaaccacgccagcgcatatccggccgccatcgcaatgaccagtgaggccacgcgtaagtaagggttacgttgacggttaagcaggataattaaggctaagaccacgcctgccagcagcagatttttcggtgcgccgaaggtgttatcgctcatggctgcgtaaccgccgccaatggaggtcagcccaacctgaattagcgacaggccgataatcatcaccacaacgccagaaaccagcggcgtaataatgcggcgcgccagatgcagaacgcgggagatcaccatctcggtacaacttgccagcatcaacgtgccgaacaaagctgccatcatggtaggaacatcagcaccaccggtcttcagcgctgtgccgcccataatcagcggagcaacaaagttgaagctggtgccctgaatagacaacaacccggagccaaccggaccccaggccttaatttgaataatcgatgccacaccggaggcaaacagcgacatactaataatgtgttgcgtgtcttgtgccggtaaacccagcgcctggcagattaatagcgctggcgtgatcaccgcaacgaacatcgccagcaaatgctgacaggcggcaaacagggtttgaggaagcggcggacgatcttcaagacggtaaatcagttcgctgttttgagtctgcgcaaccggttgcgcattttctgactcgagggtggaaacagacatcgaaaacaatcccgtggtagcaaagcgggcattttagctgaccgaaagagaaaagcaaacgtttgccacatcctcatctaaatatttaaatgagataaatgtacttttttatataacttttagttgttttctgcttaaaatccatgccatttttctattttcagctaagaattcgaaccaggaaagcatgacccgatactcgtcatatttcgccttactgcaaatgcgcgatgaagtatgacgagtatgaaagagtgatgcggacacaaaggagtaactatgtttcatctcgatactttagcaacgcttgttgccgcaacgctgacgttgctgctcgggcgcaagttggtccattccgtctcctttttgaagaaatacaccataccggaacctgttgcgggtggtttattagtggcgctggcgctgctgatactgaaaaaaagcatgggctgggaagtcaactttgatatgtccctgcgcgatccgttgatgctggctttcttcgctaccattggcctgaacgccaaccttgccagtctgcgggctggtgggcgtgtggtgggggttttcctgattgtggttgttggcctgttggtgatgcaaaatgccattggcattggtatggctagcctgttagggcttgatccgctgatggggctgctggccggttctattacgctttccggcggtcacggtacgggtgctgcatggagtaaattgttcattgaacgttatggcttcaccaacgcgacagaagtggcgatggcctgtgcaacgttcggtttggtgctgggcggcttgattggcggtccggtggcgcgctatctggtgaaacactccaccacaccgaacggtattccggatgaccaggaagttccgactgcgttcgaaaagccggatgtgggccgcatgatcacctcgctggtgctgattgaaactatcgcgctgattgctatctgcctgacagtggggaaaattgttgcgcaacttttggctggtactgcttttgaactaccgaccttcgtctgtgtactatttgttggcgtgattctgagcaacggtctgtcaatgatgggcttttaccgcgtctttgagcgtgcggtatccgtgctgggtaacgtaagcctgtcgttgttcctggcgatggcgctgatggggctgaaactgtgggagctggcttcgctggcgttgccgatgctggcgattctggtggtacagaccatcttcatggcgttgtatgccatcttcgttacctggcgcatgatgggcaaaaactacgatgcggcagtgctggctgcgggtcactgtggttttggcctcggtgcaacgccaacagcaatcgccaacatgcaggcgatcactgaacgctttggcccgtcgcacatggcgttcctggtcgtgccgatggtcggtgcgttctttatcgatatcgtcaatgcgctggtgattaagctgtatttgatgttgccgatttttacgggttaaccgatgaagcggcggtcttctcaccgccgccttttacgcattcgagtagcgttctgtttctggcatccagcgttctatcagggcttttgcctgttgtgggtaacgttcgtgaatatgtcgcgccaggcgctgaacttccgggatcatcgcctgatcgcgcagtaaatccgccactttaaattcagcattacccgtctgacgcgtacctaacagttcacccggtccgcgaatctctaagtctttctgtgcaatcacaaaaccgtcgttgctgtcgcgcagcacttgcagccgaatttgcgcggttttggagagcggcgttttgtagagcagcacgcagtgagaagccaccgcaccacgacctacacgcccgcgaagctggtgtaactgcgccagacccagacgctccgggttttcgataatcatcagactggcgttaggcacatcaacaccgacttcaataacggtagtggcaaccagcaggtgtagttcaccttgtttaaacgacgccatcaccgcctgtttatcggcaggtttcatccgcccgtgtaccaggccgacgttcagttccggcaacgccagtttcaactcttcccaggttgcttccgccgcctgcgcttccagcaattccgactcttcaatcaacgtacaaacccagtatgcctgacgaccttcagttatgcaggcgtggcgcacgcggtcaataatgtcggtacggcgggtatcaggaatagcgaccgtagtcactggcgtgcggcctggcggcagctcatctatcaccgaggtatcgagatcggcatacgcagtcatcgccagcgtgcgggggatgggcgtggcggtcatgatcaactgatgcggatggaagccttgctgctggcctttctcccataacgccagacgctgatgcacgccaaaacgatgctgttcgtcgataatcaccagcgccaggccgttaaactgcacctgttcctggaaaatggcgtgcgtaccaacaatcatctgcacctgaccgctggcgatggcttcttgctgagccagtcgtgctttacctttctgtttaccggcgagccagcccacttcgataccgagcggagcaaaccagttacggaagttattggcgtgctgctcggcgagtaattcggttggtgccatcaatgccacctgtttgccgtgcgcaatcgcacgcaacgcggcgagggcggcgaccagcgttttaccggaacctacatcgccctgcaccaggcgcatcatcggcgcatccagcgccatatcgcgctcgatctccgccaccacgcgtgcctgtgcgcccgttggcttgaacggtaaggcggcgaggagtttatttttcagcgcgtcattggcgctcagcggctgggcatgaaaacgctgtgctccggcacgtaaggctaacatgctgaggttgtgcgccagcagttcttccagaatcagacggcgttgtgccggatgctggccggtgtccagatcgctaagctgtagcgtcggcggcgggcggtgcaaagtgcgcaacgcttccggtagcgtcatcattccttgtgacagttccggcggcaggagttcttcaatggcgcaggtgtcgagcagatcaagcgcctggtcggttaatttacgcagcgtggcctgctttacgccttcggttgttggataaaccggcgtaagcgtttcctgcaactctggcgtactgagatcgccctgcacgcggtattccgggtggatcatctccgcgccatatttaccgcgctttgcttctccataggccagcacgcggcggcccgtcgccaggctatttttcattgccgcgttgaagttgaaaaagcgcatggtgagaatgccggaaccgtcgctgatctggcaggtcatcatccgccgaccgccgaaggagatattgcagttcagcacttcgccttccaccgtggcataaacgcccggtagtagttctccgatggggtagagatgggtgcgatcttcgtagcgcaggggaaggtgtaagagtagatcctgcacggtatgcaggttgattttcgccagcttgttactaagcgctgcgccaacgcccgttagggaactgagcgggacagcatctaacaggcgacctttcatggtacttaccctgcagcttgcatagtggcccaccagtcggcatcggcttcaatttcgccctgctgattgacgtgggggtaaggcaggcctttgcgttttgcgactttcgccagcaccggatagccgccttcaaacaacaggcgttgttgctctgcttccggcaacatgctgttttcacgcaggtacatgcccgcattttgccgctggcgctgggcttcgtaaagaatgagggctgaggcaacggaaacattcagcgattgcaccatgccaatcatcggaatgatgatgtcccgatccgccagggccaacgcttcctgcgtgatgcctgttttctcctgtcccatcaaaatacaggtcgggcgagtgtaatcaatttcgcggaaatcgacagcgttatcagaaagatgggttgccagaatctgcatgccctggcctttcagatgagcgacggcatcgccaatggtgcggtgcgttttcacctgtacccagctgttactacccgcagctgccgaagccatggtgcgcatccggctaccaggccagacagcatgaacttcatgtacaccaacggcatctgcggtacgaataatcgcagaaacgttatgaggtttgtggacctgctccatgcagacggtcagatcaggctgccgcctggcgagcatttcgcagatacgtgcataacgtgttgggttcataaaacattaatttcggtttcgggtgactttaatcacgtctggcatcacgcggattttgcgcatgatattcgccagatgcacacggtcacgggcggtcagacgaataaaggcgctgtagacgcgaccatctttctcttccgtattcaaactttgaatattcgaggtcgtggtgttaattgccgctgtcaggtttgccagcgcgccctgatgattgaacatctccactttgatttcggtgatgaactcctgcgccgtctctttatcccattccacagccataaacttctctggctctttctggtagccacggatgttacggcaggattcatggtggatcaccagacctttaccggggctgacgtgggcgataatcgggtcgccaggaatagggcggcagcatttcgcaaaggtgatcagcacgccatcagcacctttaatgggcagatgtccgtgactttgggttgccggtggaatggaggcgtccccatgttgcagatttttcgcgaccaccacgctcattgcgttaccaagtccgatttcagccagcagatcgtcaagcgtagccagcttcatgcgatccagctcgcgctgaatattttcctgcgggatttcattgagcttacggctaccccccaacgcatggttgagcagacgacggcccagactaacagaatcatcacgcttgaggtttttcagcaactgacgaattttggcgcgcgctttcgagctgacgacaaagttcagccacgcggcattcgggcgagcgcccggtgcggtaatgatttcaacggtttgaccgctggtcagcggctgcgacagcgggtaaggctgacggtcgacacgcgcgcccacgcaggcatgaccgatatcggtatgcaccgcataagcgaagtcgacgggcgttgcaccggcaggcagttcgacaatgcgcccttccggtgtgaaaacgtaaatctcatccgggaagagatcggatttaacgctctcgataaattcaaacgaactaccggcgctctgttgcagctccagcaggctttgcatccagcgctgggcgcggatttgtgcggtagtactggtttcgccgtgctctttataagcccagtgcgcggcaacacccatctctgccatctgatccatatcttcggtacggatctggacctcaaccggcacgccgtgcgggccaatcatcgaggtgtgcaaagactgatagccgttcgcttttggaatggcgatgtagtctttcacgcgacccggacgcggcttgtacaggctatgcatttgcccgagcacgcggtaacaggtgtcggaatcattgacgatcacgcggaaagcgtagatgtccatgattgagtgaaaacgctgctctttgagcaccattttgcagtaaatcgaataaagatgcttctcgcgaccactgacgcggcacggtattcccgcttcctgcaaacgcccttcgatttcagaaagaatcttctggatcatctctttacggttgccgcgcgcggctttcaccacttctttgattacgcgataacggttgggatacagcgcctcaaaacccagctcttcgagttcggttttaatgtggtggatacctaaacggtgtgccagcgggctgtaaatttcgagtgtttcacgggcgatgcggcgacgtttgtccgggcgaagtgagcccagcgtgcgcatgttgtgggtacggtcggcaagtttgatgagaatgacgcggatatcctgcaccatcgccataatcatcttgcgaaagttttcggcctgcgcctctttcttatcgcggaacttgagcttatcaagtttcgacaccccctctaccagctcggcgacgcttttaccaaaaagctgttccatgtcctggtaggtggcgggagtatcttcaatcacgtcatgcagcagcgccgccatcagcgtttcatagtcgagtttcatctcggccagaatgcaggcaaccgccaccgggtgcgtgatatagggttcaccgcttgaacgtgtttgcccctcgtgagcatcacgtgcaacgagatacgcctgccgcagacgcttgatttggtcttccggcaggtagttttgaatcagctgattcaggctttcaaacagatacaagggcgacccgctttgtgattaacgacgaccttcagcaatagcggtaacggcttgtaattcagcggcttcctgctcttgctgttcctggcgttcacgaacgtcgaggatctggttgttgatcagaccttcttcaatttcgcgcagcgcgattacagtggttttatcgttttcttccggtaccagcggatcctttccgcctacctgcatctgacgagcgcgacgcgcggcgaccagtaccaggtcaaaacggttaccaattttctctacagcgtcctgaacagttacgcgtgccatacttaaaaagctccacaggtgaagaaatgactgggcatgatactgaaatcaggttcagtctgccaacaatttgctgattaaagcgtcatgacgctgcttttggcggctcatgcgcagacgttcggcgcgaataatggtcttcaaatcggtcaacgcggtatcgaagtcatcattcacaatcaggtaatcatattcggcgtaatggctcatttctgcaacagcttgcgccatacgctttgcaatgacctcttcgctgtcctgaccgcgaccgcgtagacggcggtccagttcaattttggacggcggtaaaataaagatactccgcgcgtgcggcatcttctggcgaatttgctgcgcaccctgccagtcgatatcgagaaaaacatcgacaccggtcgccagtacttgctcaatggcctcacgcgaagtgccatagtaattaccaaaaacttctgcgtgttcgaggaacgcatctctgctaatcatttctttaaattcatcatgattaacaaagaaataatgttcaccgtggacttcaccaggacgcggttggcgtgtggtgtgtgaaacagaaacctgggtgtcatacaacggttgggtttttaataaagcctgaatcaggctggatttacccgcgccactgggggcagaaacaatataaagcgtgccttgagccatgagtatctttcgtatgtgattagcgaaataaagcctacatacgagcttattatacacggcgcgggcatgtgacgtagcccttgctcacactttttgcgcaaagttgttgcgttttgcgtagctgcttccgcatttgcctgtcattcactgcaataaagacgattctcaggaagcgtcctcgcagactccgtttttgccactcggctttgctttcatcacgttgtatatctgcctgactatctacagcggaggtgatgatgaaagtatggatggcgatattaataagtatcttgtgctggcaatcatcggcgtgggcagtctgtccggcctggtcgccagccagagcacaggaagaaatttcccgcctgcaacagcaaataaaacagtgggacgatgactactggaaggaaggggaaagtgagattgaagacggtgtttacgatcagttaagcgcccgtctcacgcagtggcaacgctgttttgggaacgagccccgcgacgcgatgatgccacctttggcaggcacagttatgcatccagttgcgcatacaggcgtgcgtaaattagcggataaaaatgcactacgtctttggatgcgtgaacacaacgatctttgggtgcagccgaaagtcgatggcgttgcggtaaccctggtttatcgggacgggaaactgaacaaagcaatcagtcgcggcaatggcctgaaaggggaggactggacgcagaaagttagcttaatttccgctgtgccgcaaaccgttagcgggcctttagccaacagcacgcttcagggggaaatatttctcaagcgtaaggggcatatccaacaacaaatggggggaataaatgcccgcgcaaaagttgctggcctgatgatgcgccaggggaatagcgatacgctaaactcactggctgtttttgtctgggcatggccggatggaccgcatttaatgaccgatcgtttaaaggatctggctaccgcaggttttactttaacgcagacgtatacccgcgcggttaaaaatgctgatgaggttgcgcacgtacgcaatgagtggtggaaagcaaaattacccttcgtcaccgatggcgtggttgtgcgagcggcgaaagaacccgaatcccgtcattggctaccgggccaggcggagtggctggtggcctggaaatatcaacctgtagctcaggttgccgaagtgaaggcgattcaatttgcggtgggtaagagcggtaaaatatcggtggtggcgtcactcgcacctgtcatgctggatgataaaaaagtccagcgggtgaatattggttccgtcaggcgctggcaggagtgggatattgcgcctggtgatcagatcctcgtcagccttgccggtcaggggattcctcgcattgatgatgtggtctggcgcggagcagaacgtacaaaaccgacaccaccagaaaaccgctttaactcgttgacctgctactttgcttctgatgtttgtcaggaacagttcatttcacgcttagtctggctggggtcaaaacaggttctggggcttgatggcattggtgaggccggctggcgcgccctgcatcagactcatcgctttgagcatatcttttcctggcttttattaacgccagagcaattacagaacacgccggggatcgcgaaaagtaaaagtgcgcagttatggcatcagtttaatctggctcgtcagcagccttttactcgctgggtgatggcaatgggaataccgctaacccgggcggcgcttaatgccagtgatgaacggtcctggtcgcaacttttatttagcacggaacagttctggcagcagctgccggggactggatcggggcgcgccagacaggttattgaatggaaggaaaatgcgcaaatcaagaagctgggcagttggctggctgcccagcagatcacaggttttgaaccttagtgaccttcgtggctgtagtaaaagaccggtaatcccagcttaagacgtagcgccagtaaacgggcaaaaaagccgaataccagggtggagataatcaccacatcatggttagaaacatagtgttgcagcgcgatgtacagtacggcggaggcaaatgagacaccggcatacaactctttctggaataccagtggaatgcgtttacagaacatatcgcgcaaaacgccgccaaacacgccggtggttaccgccgcgacaacggcaataatcgggccgtgccccatatccagtgcaacctgtgcgccgatgatagaaaagaccaccagtccgagcgcatcaagcaccagaaacactttgcgcaggtaaggcattacaggagcaacgatagtggtgagtactgcggcggtagcgacaataatcacatattccgggtgtttgacccagccgagcggatagtggcccagcagaatatcgcgcactgaccctccgccaattgcggtagcagtcgcaataataattacgccaaatgtatccatgcgccgccgcccggctgccagcgccccagtcatggcttcggcagtaatgccaaccaaatacaaaatgtgtaacagcatggttctctccctaaaaatctgtctggaagggtagcgatttgtgcgcattgtcacgattgagattttttaaggtgagaatagattgataatttgtagttatgtgaaattgctattttctgtagcgtagatgcattcttctgacttcttgtctgagaaaatgcataagaaaaaataggttaaaattgaggggtggaaaagaaaggtgcaatgtttagccattgtgttcaccgcacctggactttggcttacgcatcgggtatctcaatcaacaaaaagagtttttagtttctgctatttcttctctgtaatttttacactgttttccaactgcttgatgctgacctgcggggtcggcaactcctcaggcatggttccgccaagttcctgaatggtttgcctcaccttgcgacccacgtcaaagtgtgtggtattagcttgctgttttgaattcacgccatcccgcttgagtttttcttctgtttgggtagctcgaaagagattagccgccagttctgttgaacccatatgatccaggatcttctgactctttttcagccccttccgctgatgaatagctttctgatctaatccaccatacagtccccggtaaccatgattctgaaatatggcgaaatcgatagctgtcgctaccccagcttgctgcgctgcctcaactaattgtttgttatgttctttcaactcatttctcagaaaaagacgcttttcgtcttcacgaagttgcctgaaagcttcatcgtcagccagctcctgccgtcgggtctggatagcaaaataagtttgccctgccgcaataaccggtttcgcagggtcgccgttttgtactactaggtaacaggcatagcgggagagatgaacatcttcaagttctcgttgagcccctgaacctaatacaaccattttggtggtttcaacgaaatggtcagatgcagcttgattgctggcttcgcacgcttgagtcgcgcgggccagtaccttttgaaaattgcgccagtcccgataatccagtaacggtgccaattctctcgctgaccaaaattcttgcccttcagtgccataatgccgtatttcttcaaaaggttgatgatgttcgttcattgcccactccatgtgatatcgattgcaaagaaagtaaatctgtaactgtatttatatacagttgtgagtatctcacgttctcagtgtgctgggcaaaaaaacatcgcaaaatctggagcaggcacgcaaaacagaattgaagttgcggggaagaaaaatgccgctctgtttgagtgggcggcatttgtgaaggctgaaaagtaagaattagtgttacgagttactcaatattgaatctgtttgtagagtattggcttcaatgccgcattgtggctggtttcttcctaatgcgatttttgattatgtacacccttatgtacacggttttttctggtgctatcaatcattgagcatttatcgagcactgtttgctcagtaagaaattgtcggtatgcagatagttatagtaccggattcggtttttagaccgcctcccaaaccagcattaattagactaaaagttcacttacccatgctggcattaacaatgttatcgtatacgcattattgcgtctttataggtgttaacatggctaaagatttaacaacctccgctcatgacagacaaaatattctgaacaactcctatgcactccgacaagctgaaaaacatcttgctcttggtggagttgagttcaatggagaacgactttttacaaaaagtcaacttatggaaatttttggtataagcgatgccactgtggaacggtatatcgccaatcatagcaatgaactcaagagcaatggttatcgacttataaaagggagagagctaaaagaattcaaagggttagagcatgtctccttcatcaatgagggtaacaaggcccctactattggagtgtttaattaccgagctgtcctgaacttcgccatgctactggtcgaaagtgagcaagccaagattatacgtacgcgcctgcttgatattgtcattgatactttagccgaaagggctggtggacataccaagtacatcaaccaacgtgatgagaattacctattggcttcttttcaagaagaaagctatcgcaagcaattcactgatgccttagatgaatgcgtcgaagggaataattggaagtatgcaaggtttaccaaccttgtgtatcaaagtattttccacgaagacgcggccgagtaccgcaaggtattgaatcttgctcaaaaagagaaaatccgggacacaatgtactccgaagttctaactcttattgcaggtttcgaatcaggtattgcacatgaattaaaacaagaattctctcgtttaggcagaaaactgacacaacaggaagcagaagctatttttaaacaatttgaatctcatccattgtttaagcctatgatgctagatgccagaaccaaaatggcaagtagggatctctgtttcagagatgcgctgcatgaaaaacttgaagcttacgtaagagctgtacctgaaggggactttgaacgtttcttgggtgagaaaagtaaatcacttgaagagcgcctgaacgacccagaaaccctagaagtgttcaaaagactaaaagaccgataggggtataaatggacgatatacaattcaattattttgatattgaacacgccattagagttcatgattggatcattgagaaaacgggcggcttacacggaatcagagaccaaggggtactggcgagtgcccttgagcatatccaaaacgactggtattacccaggatttgtagacaaactaagtcacttgttctttgcaatcaataaattccatgcttttagtgacggaaataaaagatcaagcatcgccctttcaacatactttcttgagataaatggctttggccattgtgtacaactttttgtgcgagaaatggaaaacatcgcagtttgggtggctgatggagcaatcgataaggagctactcaaaaacatcattcatgatctggtcttatgtgaagaaatacttgaaacgactaagctggaaatcgccatagcagttatgaattatgaaactctaaggcactggtgacaaacacaatacaggatgggaagtatcgcaaatttgtcagcatatagctaagatgctaggcatatttgttacgcgtgcgtattgctcgcgaaattgctgtacccaatagtgatgtccgaaaaaccttccggcctcacataaaacagccatgtgaaactggtaactgaacagacgggcagaccgttcgttcagtaaatacctgatatttccgccaacgaaaaattgcgttggcgggcagagtgcaaatttgcacgatgacctaacccattgattctttcgaaaacccccattgggggaaaagcctaacccattggtttttccacaatcctcaatttgaggaatgtacctaaaaccatttttatagctccgatcccttcaaagtgaggggtaatttgccaaaacagagagagcattactgtctctggcaatctctatcgcgataacgcctgaagtaccctctcgcttcctcatccataccaagagccgaatgagtccgcttaactgcctgtcttaaatctccgaatctgtctgtagttgctggtgggcgtgccgccttacggatacattcagagcgtctgtttgctgcatgttcacgttctttatcgccatctgccagcatcatgacttctgcccatcgtgcggcagctctccggtatagcccttttgactccagctcttcagctttcctgtcccttatcatttctgcctctcagattatatagataagcaaaaaggtgttggttcagttggttcagttggttcaatttgtaaagatcgttgtttttattgtgttttttctgaaatattgaaccaacatcaactcattttgaaccaacacagcccagctctgaaccaacaacacagcgatagctttgtgattggcccgttattttctggctgatatttgagcgtataacagtgttatacagtggtatactgtatggatattactcactgatatggtctttgcaatgagcaaatctaatctggtcgcgttccgcatcccatctgaattgcaggatgagtttaatcggtctgttctcgcttctggaggggataaaacctcctggcttgttgatgcgattcgcatgaagctgggacagccggaaaagtctattgattcacgaatgcttgggctggtggagcgcatggaaaaagccgctgcgtcgcttattgccggaaagccgaacatcccaccaaagccatataacgaaacggcagttataaagatcattgccgataccatccgacagggatttgataatgggcgtgtgatagcggaacggctcaatgaagcaggctatcaaacaaaagctggtaaagcatgggataaagacatttacagcgcgtggaagcgtcagggaagcaatgctgaaaagttatcagtggctctaagaatgtagccctatattttgatttttagacgtgcttggagaacaggtagcgtgccatcactaaaacaatgccaaagacttcagcgagggttccccccataaataggtttataacgaaatcactaaaatggagcagttttgctccaataaggacaaaaatcccattcataactaatagctggcctatcagaatgccgataaaccaccgagcaaacatttttttcagttttgtgtctgtttttaaatcttttgtttttgcacgctgatgggctttggctggatcctcatcatttagatgtgtgagggtttttgctgatggtgatgagccagaggctggttcacctctggcttgtcttgccgcttgctttagtttttcagatatagcgtaagatctagacgtcattactcatcgaagccctaaattctttaggcgataacgtatagcatcatcggatacaccaaaataggaagccatcattactggtgcatatcctgcattgttgaggcgtcgaacctctttttctggcatgagaagacatgctgcaaagttattggcgaatatttcttcgctgtctacaccttggcttgccagttttccgcggtaatcaacaaactcatattcaagtggctgaccgttctcagttcgtttgacgtaatgccctaactcatgcgcacacgtaaatcgtttgcgcacgttactatcattacgattgagtatgattactggatcttgttctggctctttcagcaatgcgcctgaaacatcatcatcaagcgtggtttcaacaacatccaaccctaactcattggcaatccatactggatcaaccgggaatttcctatcgccccagatatctttcaagagggcatgtgcagatgtattcgacatgttcacctcctttgattatggttaaatagtcgaaattttcaccacttcccttgtggatatatttacatataaaaggtaactagtcactaaccaacacaaatctttttgaagacagatggggggtgttgaacggtttttaaatgatttctttgatttttaacagcaataaggagcatttttaatgaaattagacgttgataataactttttgagcaatctttacatatcatggtagccttctatgctgtttttccaactaaaagattggcacatttatccgctggtagtggcgttttttcgccgccagcgcctctctggttccattccttacatctgttcaaattcagcaacccttgccgcgatcttgccgttatcgagaagctctttcgcttttcggttaatactatcggtcttcatattgccagcagcatacgccatccgataatttcgatgctacgcgcgcgtacttgtcgcaaaatatcaggcaaaggccagattcagaaagtcgtgataaccaccagcacaacatgagaggtcatgtaacgcgatttatcacaccagatacatgtgattggtgtacccgcataaaacatcgtcatagcgcgtcctgtgcgcatatacgccgataatcaacacatcaccaccactctgtcttatgtagagaacagttttatggtgctccccgccatcgtgtgcgtactggtcggacgcagttgcaaaaaattttgcaactgatacccctcgcgcgcgtactggtcacgaaattggtgttttgctgtggcagtgatatcagaaaaatcttcctgtttcacataaagcggatatgcgcgtactgtaacggccccatcaacggggatcggatttgaaatcctgacccaagctatgtaccaaatgccatgtcttggatatatgatgattgccattctaaacaaagctaaagggagggttggtgtgaatgctcaggctgtcatcatggttttccttggtctgattgtcgcaaaactatatccagactggtggaaaggggcattagcaactgtcgccatctatttgcttttatccgtcgttaagcgatcgttcgttaagaccgtaaatcaagcaaaacgtttctcatttaagaatttaataaactatattactgggcttattttttgcctttcaattttgatcgcttcagcttttttgcccgtatcaatagctaatttttttggcgcaccatatgaggtaggttatctattctctgttttttgtcttgttctttcccttctttacctatggatgagagcaaagaacaaaaattagccatccgtggctaaccagttattgagcttctttttgtgatgcctgtgcgactctggtgagcgattgtgtgaccgtactgatcgctctgtcatatgctgtgctaccttttggtgtatttgccagacgtaacaaggcatttcgtataacagggctttcgtatgccttcgctgctccgcctacggcaccagcagcaggaacaacaaacgcagctgtttttagcatccccgctaatactgctgcgtttatgatgccaccaccaactaacaatccataaagctgctgaccatttaagttttgaacgttcgcttttgccgcgtgtcttgtatcgttgaggtatttaataacgccgtccagttcctttccatgtacgcctttaaagaaagttgctgattgcttcctgttccggtgtaacgcattaataaacttctcaacactgatatttccagacggatcagtcgccttatctacagcattctgaactatggctgctcgtgcgttttgcctaccattgtcatccagaagcctgtaaagctgagaacgttctgatgggctttggctaaaaacgagttttgttacatcctcaggcgtggccttgccgctggctattgccttttgaacgcgcgttcttcccatcatgtcattgaatttagaccatgagcgatcaacccttgccatattaatggcttcgtctgctccaagatttttggctacggcttttttcatatccgccgtatatgccttgtagataatatcgctggctttctggagcgtatctttatcaacagtgtcagatgacgccataaatcgctttcgaagatcggttctgttttccctcgccagacgcaggtcatttggtccgctggtgatatcgtctttaaattgctgcaagacttttaccgcggctctatcctgagatttgcccgggcggcttaacacggcaatctgattgtcgatagcttttaccgtgtttgagagatcgacaggggtatcccccatagcgtcaattatgcggttatatcgctttcctgctgcctcaatgaatttttgttgccctttagtcgcagattcataaagctgtttatcagaaatgccacccagaccatcgctaaatgttctgactaaattttctcgtgcttgttgttgattcagccgattcttaccggttccaaaaaaaggaactctttcgcctaatgtctgagcctgactctgcataaaggttttatctttcagcatgtcactggtcattaacggcagatttctttccgatgcaaagtcgacagcagcctttgcttcaggcgacatatcaccacgaacagccctcgaaaccgcactcgctgtattttccagccccttgccaataccaccaatgccagcagaaattaccgtttgtaacggatcaatatcttctccaccagcaaggctggtggctccctgtagtgctaaatctgtagctgctgattttcctatggcaccaagcaccgttccagccctgcccgctggtgtaaacgccaacgcattagcaagaaacgaagtcaggtcttgcggtgataaacccggcttgtttagggcataatcacctgatggcagagaaacgatagtattccccttctcatcctgccttaatgtcgcccccattccctggagaatcttttcctgagacgcgtcagagccgaaaagttgagaccatccagcctttagggcatccatgcttagtgagttcaattctggggcagaggcgacattttgcagtctctccatctctggagtcattcggctttcgcctgttatagcatcccgcatcgcagccccaagactggctccctgttctgctgaacgctcaagcccctctctttgctgagtagctaactttgcataccctgacgcaagagaattatcagatgatgtatgttgaatattttgagttgctgattgggatcggtctatttcattcgttgatggtagtggataggcagcataaaaagcctgcttagcctgctctacactttctccggcttgcggggccacgacttcattgaagtattgctcctgagcctgcgctttttgttctggtgctaacgcctgatactgtggagaggcgataacatctttccatgctttagccattaatcaccccatagtgaagaaaagttactgctggctgctggctgtgatacctgctcagattgcggcaatgtctgcgacgaagaagaagttcctctgtcaactgctgaaataacccgcaaagcatcataagctcgaccagaagcagctttcagcgaattgaactggttttccatcttccggcgcttggtatcaatggtttttgtggagtcgccaggctgagggaaatacatttgataatattttgacatttcagcaggtacgatagctgcccctgtttcctgacggagtattgccattattgcgtcattagcattaacaacgtattgctgctctgttgggctgagcgttaagttagccagcgtcccattacccaaagcattattaatgaccgccactcgctgtgggctaagctggtctttcagtgtatctattgaatcaagagcatccctaaccctgtatgcaaatccagcagcttttttagccccttctggcgacttttccatgatcttttgggctgttggcaaagctattggacgaaatccatctccagatattggctggtttagttttccctgctcttcacttccgtctgtgtagtattttgtgacagtgccatcatcgttttctctaacactcattaattttttggcgtttgtattaattccagccgctgccgcaaatgccgccgccccctctggatccgcctttaacatttgagcgtactgattgtaattctgcattgctgctgttggtgcatatgctgacgttaacgcatttgctcggctaatatcctgccctctcgcctgaagtgcttcgccagcctgattgctgcggattgtctctgccaacttgccacgctcaatatcccgaccttccatttgatctttgatatcgaaatacttctcatgaccgagagaaaacagtgccatactaccagcaagccgctggaacccctgtggatcattaacatgcatttcggcaacagactcaggagaaattcccaagcgacgcatttcatcttcgttatctgctatgaattttccaaatgccccagttccgagcgaagatgcgatttgagcactagtcgcaagatgaccaatagaatttctctggtcgtcatcaataaagcccatccctttctgaacgctttcaaattcttctggatactcagaaataagactgcgcattttgtttctgtctccagactcaaaagccccggcatatgctttctgaaactctgctttacgctgttgttgacgtgcctgctgattaatctcagcaacgcctcttagcccctgtagcgccattaaacctacgtttggctgctgctgatactgcacaggctgaggaacggaagaacgaggagcattatcattttgcggtgccatgctaggcagcccgccaagttgccatgtcgccattagaatccaagccccccaacaagaccaataagcccaccaccaatagcgccggccgcagttcctattccaggaacaacggaaccaagttgcgcacccgctaaagcgcctgatgctgccccaccaataccacgcgcaagactggatggctgctgcgcctgacctgcacgaatagcgccaagcccctgcaagagttgtccggtattattggcgtagttttgccctgccgttgcctgccctgatgccgcattcatcccgacatttagcaggtttccataattttgcatttgcccactaagccaattgttataaagcatgggcgcaatggaagataactggttactggtagctgttgagccaagccccccggtagcttctgctgagacaaggttctgataacgggcctgatctgcctgtgttttatataaaccagaaccaaagaaatcattcgcggctttattctgcccttccagagtcatcagtccttgtagttgttgtaaagcaggcaatccgacttctgcatacggcttgagattattcatcaccgtattccactgctcgcgctgcaaatcaattgcctgctgctgggccttcgcctgagctttagaggcgccaccatcaccgcctttttcgtatacggcacgattgagatgtttatgagctatatgggtaattaacattcgctgaattccttatattgttgccgagttaactgataaagcgttacgccgacgggtttaccacatctgatataagcatcatcaaggtgaccaacacgggtagcgccaagcaaacggataattgcccgtccgtatttcgtggtgtcaggaaccatagtgatgctgttaaggaatggtgagttttcgagaagccatttgcagaataatcgatgtccttgcagtgcatattcaccacggaatccggggtcgtacaccgcatggcattcaacaacgctatgccagaagttacgcacttcatgaacgccagccagcactaatccttcgtagatgccgagatataccgcatcaggcttgatgtagtacgtgtgccccggctcaacaatattttcggtattgcctggctcgttaagaaaggcctgtaatcgcacagggttatcaataaattttagttccatgcgatgccatccattttcacatacagcctgccagcgccttatctattaaccctcgtgcaatttcatgcagagttggcgctactccaattcctgattttttacgctgctcttcctgaattttctttatcgcttccatttgcttctcacttatcaataccggctttactgaaatagccataacgcccccttagaactgtataaaacaacagttattatagtttcacaaatcgcaatattcatcatcgtaattgcaaaatatgaaacaaatagcacaaaaaaatgccaccgctcagtagctggtggcatcgttctgtgtgtcaggttttgacaggttttttatggactctaaaaactatatttatggtgtcgcattactcttcacggcaggcgcttttcagttctgcccttgcttctggctccattggtaatttgattcgcgatcagctatgcggatggtttgctgaacaggcataacaacttctcagaggctgttttctgaactacgaaaatttcgtagtgctcactttcaaaaacgtcacgcccttgtacacaggattttacgaaagtctcgtaaaacactctctgatgccagccaggtgttgtgcgcatcaattcagtcacattgtgttggttcaaaataccgtgttgttggttcagtgttggttcaataaaaagaataaaatccttataaaacaatactctttacaaattgaaccaactgaaccaactgaaccaacaccttttctacgcacatgaagaagctcattcttcagatgagttataatctcctggctggtaattgagtacataaacgtttatttgtcgtccctgaatacgtggtgattttctttggtatccacgaccgctgtttggtggggttagcatcccggcttttttcaacacttcagcaaactgttttgcgttgaaaccacatgcgatctccttttcaaatgtggccgggaatgtgtagaaaatcattgggctttcgtcatgttctccacgctgacggtatccggctaaatctttgatgggcaaatctgccgggctgtatggaaatggtgcaaaacggctaagcccataggcattaagaaatgcctccgtttgttcaataatctgctgatgctctttgttacctgtgccgaactcgcgcaaccatgcgttatagctgtgctgtatcgcatcacggcatgtctgagcatcccagcctgttacaacctcgcctaacaacaatgcggcctccagaatggcaaatcgcgcggctacacggtgaacctgctcaccataatcggatgggatcaggcttctccatctgctttcgcagtcacgaacggttttaatagcctgttgctggtggtctgccagccatttaatccactcacgcccggacgcgccgtggtgatgctggtaagcgtctttcagtgcgtctgcgtgctgttttccgttctggtaatcgtgaaagcgtactgctttactcaacggaatattcagcagtcgcaccagttgcccggctttggtttttcgcccggaagtagcgataaatgtttctaaatccatttctccggtgctgattgccactgtacgccagcgttttagatcccggtttccaccatctttagcgccttgcagtttccctacaccgttaaataacgcataggcagactgtgaaacgctgacaggatcagcgccctgaccaacttcatcaagcggcattagtccgtcattgtgggcggcggcctcatttgccagccccagcgcggttccgtaccacgtcagccgcagtaaatcagggttgccgtataagctgctcgccacgtttgccgtggtggtcttacctgcgctcgactgctcatagaaatgaatgccgaacccgtcagcgcccaccagcccaatcaatggcgctgccagtgctgcgccgatcccggtcatcattgaatagttaccaaaggccagacgcgccacgttatcacgccagcttttcgcgctccctgagacggtatatccggctgcggctgagcttctcccgctgaacagcacaggattttcaggtgttccgatgatttccccatcaggcatgatgtacgctccgcattgccagccagtggcatgagcaacacgccacaattcacgagagccactgcgttgtagccagtctgccagtattgctctgaggctgcttttggtcgtgacatttaccccaccagctttaagtgtgcgccatccttcacgttcaccaatatcagccagtggaatggcagcggttgtcggcgtttcagaaccaaacgacagccagcgaagaatgagatactggtctttatcgtctctgccagtaccgataacgcttaacggagaacataaccagctttcgttattgatgatttctccactctggctgtcagctctcggagatacccaataaataccatcctcgcggctttctattcttggtttcagtgggtcggtatccataaccttaaaatcgcttccctcaatggtctgtggctcctgtttcacgccattaccctgtggttggtacattgacttattgaacgcttctgtggcgcatttaatgccgtgtttttggtggtaatcattccagtctgctttgtgatctgtcgggggtaatgccacccatccagaaacagataaagctgctttttctgctgctattctccccgtgttttgtcttccttcgctgtggtcgttatccgcagcaatgatgatttgtgctgaaggaaatttatcccgcagtacctgggcgacatataacaggttcccggcatcaatcgccgccactgtcagcgcctctggacgaattaaatgggcagataatgccgttgccagcccttctgtaattaagatgctctgtgttgtttctggcgcgtttatggcgtgatatgccccccgctttgctgaacctctcaggagtcttttttcaccatgtgaggtaatagtctgtgctgctgtgactgcgccggatttatccaccagcgccagcaacagagatccatcgggcaacacggggaatgtaaaatcacctacccctttcgcaaccagataatcagatttgccgtttacagcctttctgcgcatgtcatcaaactgacgggaaaacgtatcccgtctttgttgttcgtccttctctgcccttttcaggcgctcctgttcgcgtcgctggcgctcggtttccagttgttcccgtttctggctggtggcttctggtgtttccgttgtccggtaatcaatacccagaacatcagcggcaagaagcgccgcctctgttgtgtcgcagttatttacgcgtttaattaaatccagcccatcaccagcgccgcactgattacagatgaagctaccgcgcccgttgtcatcgaaccggaatcgatctttgcccccacatgcagggcagggagcatgacggcgcggagagtcagggacatttatgttcaggcagcccagcacatgaggccagttgttttcagacgcactgataacctgacggataagatcaatgtttcgcatcaccgtaccccacgtggtctatagcgtttgcgatatggctaaccagcatctgccacttggttattccgtaatcagtcagcatgccatcattgtttagccacatatcaaattcagcggttgtcgcaagtttccacttatcgccgtggacagtcctcattgctgggtacatgaatgcgcaaatcagatcacaaacatctgacggcttcagagatgtagtaatggtgcgtccctctggcgtctgaattgccattttctcttcaccagtagaatgaaggttatgaatccacacagcaccagcaatctttgccacctgctctccgattgcggagctaagcgccatttctgcattttcacgcatgagaacctcccgctacagttgcgcccatgtcattaaccatgctttgccatatctcacgcccgacgtcagtcaatccgtccttagtgacgcaacgctcaagaagctcgatccccacggtttcccactgcgggtagaacactttcatggctgccagtgtgtagctatcgatcaggctgcgaacgccttttactccattgacgatttccacacgtacggcctcgccgtccgcatcaaccatgaaatagtccccgccgctggtggaggtaatgtggttatacagtgccgacgcatacttatttgccagcgcattcagtcggaaatttttagtaatcatggctccatcctcagtgcgtcactggttccgctggcatgccgttttcattcagttcagctataaagctgttgtgaagttcagcaagcgtttcacgaccaaatggagtcagtgctccttgttccacatccatcatggctctgtagaaaatgatggcgcgttctgtgccagactcgatgccaaaacgttctatcatcgcgccctcaatgttgtttgccatagcgaggcgctctgctactggatacagcggcatggcgacgatgccgttggaataaacagccacttcggaaggattgccagtatcatcaatgatgctgacagtgccgttttcctctctcatttccagcatgaatactgttgcgatcagccatctccacataatgacgttatgctgtgatgtgtaatcgaaatatccctggttgccgccatcggctatagcgagatgtattgacatgccttcatctggtttatcgtcataatccccggcatccagacgatttacggcatcaatatatgagacggtctcaacgcgttctgtcatgccatcgttgctgcggtgcatgatgtttacgccgtcaggcgttgcttctgcatggaaagttaagaaattattcatgtttcgcctcgcctgaatgattctgtaactcatatttgcccaacaattcgtctgcttcctgaatagcttctggtacgccattgagcagtgacataaccgcgccaatcattaacttgtctctgttgctggggctggccccttcaagccagaaccctaaaacagtctgaacctgttcgatgcgacattgcgcttcaatgagctggatgttggtcatttcgcactctccgcatcgattaaactgatatctatcagagaggtaactttttgtagccagctagtgattactgtcgcctgttcccctcccaccgatggaagaatctcattcatcacatgaaccagacctgtgcgcgctctggtaagccgttcagtcgtgcaatctgcaagagtgaatgtgtctggatatggctcttcacggctcagcaatgattcaatttccagctcacacggatgacgataaattaagttgatattcatttttcacccccaagaattaccagctctgcacgggcatcgttaaccaaagatgagcacgctttaatcgcatccacgacatcagtagcgtccatttcttcagccgaaagactgacagcaaccaggacagccgctgcttgctcgattaattgaagtgcggacgtaaggcgaggggtattaattgagttattcattggtttcccccgtttttactggcatttcgccaccttccagcaggaaatgaacgtcacgaacggcgagatccaatatcgcgagtaacgccttcagtctttcgtctcgtgagggagagttgctcaccagaatgtcgttaatcacttctgtcagtgtgatgatctggcttgtgcgttcgaggggatccatatgcacatcgtaggttttaatcatgtgccacctccatgcggatacgaccagcaaaaaagcagacgtgatcgcgcaccagagaacggcgagcatcgcgttcagactcggcagcaatatgatgaattttggcggtaattgtcgggcaatcgcggcgaactgcggcgataatccagataaattgcggtttttgggtaggggtagtagccagcatgtggcagcctccattcgatagcatgtaacgctaccaccggaaacgccaatttcgctggtggtagcccagacagggttggcgtaaccggctcgaatggataccggcgcttccgaagaagcccctgcctgagccaccattgattgacaaaggcgctggattatacaccaacgcccaaaaaatgggtgagtcagacctacgacataaaaaaagacgctcggcgcgtcatatgtcgccattcgatttaccaggacgccaatcccggcacccgttttatgaggtgccttataaccataaaccgtgttgccgcataacggcaagctcttttttatggactccgaaaactcactattggaagaaccagaagcacagtacatcgcgctcatttcgttaacgtcacgcgcgtggacgaaggtttttgtggagtcactacgcgagcagagaaagccatctacgaccagaaattctctggcgcagccgctgaccttctcaacgctaacaccatcgaccgtaatttctgacatagttaaggcatccgctcctaccaccagcaaatgataaactttgcttgtatctgctgtattaatgcctgactttgctgtcatattgctggattttggcgacataccagccagtgaaaatgtcttcttctgggcggttagcatttgttaacctccgcgaactccttcatgaaacgtgccagcggttgtacgcatggcgattgatacccgtcgcgataaaacgtcactcggttgtgagacacgctttcgacagtaacgagtgctccgtgggcatctttgtagcgtttttgaggttgtggtgttcctgtcggcttaaacatggaccgcctccagacgcttagcgagccagcgttgcgacaggcgggtgagttctcctttgcgctgctcatattccatgcccatatcaattaacgtgatattggtgctttcgagatatgagaggtgctcaagctgttctgcgttcatatggtcgcgaggttcgccagaatagccatttatccgcgcccactgcttagcagttagcccaccaagaacgatacgagaaatcatattgctctcgtttgtgtagtggtgttgctgcgtcgttttccctatctcggcacgggccatattcagcgcatcgcacattggcttaaagttgtttgcggcactgatacgggcttttagctggcgacgatagcgggcggcgatttcaggcacgctacgctgtaattcttcctcgcactggatgaaataacggcggatagcgcgcccctgatcattgcgttcgatcattgccagttctttcgccattccgacacttaacagatagtctttgccgggtctgccagagtgcttaatcttgctgtaagccgtgccattcgggcttttccccaaatttggggaaattgttttatggactgagtaatcgtgcccaatggtgaagtcatattcagagatgcgatcagtgatccatgtagagaagtcttttcccacgcccaacgctttgtgtaacgcttttgcgctaacaatattggtttcacgcccaccgatatgaccaggaataaccgggacaattgcggcaaattcattaccgttaattgtgcccagagaggcgttcagatgaggggcggcctcagaaattaatctgcttttttcgatgttcattttcagtctccgttaggcggcgttaaacgcgttcgggtagagtttcagaatgtcggcaatttcctgctgagaaagtccgttgtgatcatttatgttcgcaagatggttaacatgagtgatcactttcagaacatcaccacggcaggagaaacggtagcgaaggtgtgttccgataccatcaggattcttttcgtcgatacgctccagagtgattccaagctggcgttctaactctgttgcatagttacgaccagaagacagacggcagtagcgaagaatgtcattttctgtccatccctctataccagtacgcagcatatagactctggcacgatgctttttcggtgtgcgctttggttcttgaagggattttgtaaggggcgtaacatcagatacgcgaatatctgaattagccgcctgtaatgggcggtttttcttttccatcaggccaccttcccgcggcgttctgccagccagttgtgaatctcaaccgcatcaaacgcagttattttttctcccagctttaccggacgtggtagtgaaccgtttcttactttacggtcgatggtggatacactaacgcccagcaattcagccaggcggaagcgtctgatatagccttttgtaggaatagtgtcggtgttcatgcttcccgtaacctcttagcgatagttgttgcttcgttacgggaggaagtatctgtacatatatgaacaataaaaaggcacagtaatgatactgtgcctgaatagttagctactctaccccttaccgttggcggcagcacgtaagtgtctcaaaatcacatcttcatttgtgattgctaacggtggaatttcgtctttatgagccactatgcaatcccgccacttctcagggcttatttctttctttttgccacggcattcatcaggatactttgacaaaagatatattgctgatttgaaaagtttttccctgttttcagcatgtctctcggcattatggttgctattttttatttcaggtattagttcctgttctaccgccatttcgtatcgttttttgctcttagctgcgtcaaaacttccattaacctttgcgtcgtgaagatattctaaatcagcctttgttatataaatgtttttatctgacaggctactcaggtgaatctgggaactttgcattttgaatttatatagatcacaatcaaatgttgcttcaagtcgcacatatggctctccacattcttgtgaatgataatgtcgtgttgtactaccgcgtacacgcaacaatccgcatgcaattgattttcttacaataaaagagtttttgccaatttgttcaaaaacatttttattgtctctgtcttcaactgtcagtggtttatgtgcataaaatagctcataagcaccgctttcagatgctgggatataaacttcgttgcttgcgctggtaataagaaaaggaaatgtaaaccttacttcttctgggtacataagtaataaatcagttataaaatcagcatcttttttgaagtggatggcggcatcagcttcaatgaaatcaagaaagtcagcatagacataaaagtctatatgtagtctatctttccaatgccatatatcatcaatttcacaatttaataattttgatgctcgctctatcgtgcagtagtccaaaggtggaatacctgattcctgccataaatttctatgcaccgcagttgtttcatgagagtcgttcattgcgtcaccttttacgctgcgccttattttgtgattgagccaggcggtaaggcttcccgcttttcgccccgtcgagctaggctcaatctattcagttagttcgcccttctgagaggcgttacgttgtagtcttttccgctttccagtgccaccagcagatcagcccactgtgccagtgctgctttacgctcatcaaaatactgatggcggttataaatcccctctacgcccttaatgcgatgattgaggcatcgttccgccacaacaggatcaacacccaacgctgctaaatgagtacgtgcggtgcgtcggaagtcgtgaatcgtgaaattaggcacatccggcatttcggcgcgaaccttagccagtgctacgggtaaagtgctttcctgaatatgtgggatcattctgttttgcatcttcctggccggaagcacccatgcgctattacatgaaaaggtgtgtagctctctcaaccattcaacggctggggaaggtagaggtatatcaatagggtctccgtttttgctgcgttcttccggcaaatgccataccgcaccatctaaatcaaactcttcccatcgtgcggcgcataactccatcttacgaacgcatagtgccagcaatagcttaaatgtcagttcgttctggcggctgaatccttttgcggtgcgcatagcctcgaatagcctgataagctcatcgcgagttagccaacggtcgcgggaaacctctttaccaccagcatcagatacttcaaacgctgaacaagggtttatctccagagcgtggcgttttatcccatagtcaaagatacggcgtgtccagcgtaatacatctgttgctatcgttggtgctcctcggtcaacgatacctttcaacatgtcgtcaatgtggcgtggcttaacgtcctctaccttcatatgcccaatgcaggggttaatatccttatcaattctccggcgaaggatatcgggatgtttccatctcggaagtatctggcgctcgaagtattcggaggccagatctgaaacacgcatggcgtttttctcagcctccatttttgccagtgcttcagtttttcgttcctgtttctctgctgctacgtcatagccaagagcaactctggctgacagctcttttgctgtttctctggcttttgatagtgacagttcggagtaagagcctataaccatagcccgctgctttcctgcgagcttatagcggaatcgccagaacgggactgtgtagtttttggggtagcaaatataaaggccgttgccgtctgccttgccatcaaatctgtctcccgcctttatccatgcgcggatctgcatatctgtgagttttggcattgcgaatacctgaatatcgaatatgggtgtgtacataaagcaatgtacatgaaagtcattatgtacacctctatgtacacgcatattgtgcgctttgttgcgtcgttatgatagctcatgataacaaaaaagcccgacatttcgcgggctttgtgtttttttgctgcttggtgatttttactgatggcttattcgatattctgaatctgctcgcgcatctgctcaatcaacactttcagctcgatggcagaattcgtcacttcagcattgatagatttcgacgcaagagtgttcgactcgcggttgaactcctgcatcataaagtccagacgacgaccaaccgcttcttttttcttcagaatgttgtaggtctctttgacatgcgcttcgaggcgatccagttcttcggcaacgtcaattcgttgtgccagcagaaccaactcctgctccagacggttgttttccagttgcacctgagcatcttccagcttcgcgaccagacgctcacgctgccattgcaggatttccggcatatgggcgcggactttgaccacttcggcggtgacgccttccagacgctgctcgatcaatgctttcagcgcctgaccttcggtttcgcgcgcgacgataaagtcgtccagcgtaccatccaacgccgcgagaatttcagcggcaatcgcgtcgagatcctgctcctgggctgccatcacgcccggccagcgtagaatatcaaccgggttgatttccccttcgtcactctgcatttttacccagttcgcggcagttaccagctgtttagccagtttttcgttgaggatcagctcaccttgtgcgctaacatctggctcataacgcagggtacattccactttaccgcgcgtcaggcgagaacgaatacgctcgcgaacgacaggttcaaggctacggaactgctccggcagacgaaagtaagtttccagataacgctggtttaccgagcgcatttcccaggttgcgctcccccattcacccttgatttcacgccgggcgtaggcggtcatactgcggatcatagacgttcctgtttataaaaggagaggtggaaggattatagccatcgatgccttgtcaggataggaataaccgccggaagtccgtataatgcgcagccacatttgtttcaagccggagatttcaatatgcgtccagcaggccgtagcaataatcaggtgcgtcccgttaccctgactcgtaactatacaaaacatgcagaaggctcggtgctggtcgaatttggcgataccaaagtattgtgtaccgcctctattgaagaaggcgtgccgcgcttcctgaaaggtcagggccagggctggatcaccgcagagtacggtatgctgccgcgttctacccatacccgtaacgcgcgtgaagcggcgaaaggtaagcagggtggacgcacaatggaaatccagcgtctgatcgcccgtgctcttcgcgcggcagtagatttgaaagcactgggtgagttcaccattacgctggactgcgacgtgcttcaggctgatggtggcacgcgtaccgcttcgattacgggtgcctgcgtggcgctggcagatgcgctacagaagctggtggaaaacggcaagctgaaaactaatccaatgaaagggatggtagccgcggtctctgtcgggattgtgaacggtgaagcggtttgcgatctggaatatgttgaagactctgccgcagagaccgacatgaacgtagtgatgaccgaagacgggcgtatcattgaagtgcaggggacggcagaaggcgaaccgttcacccacgaagagttactcaccttgttggcgctggcccgagggggaatcgaatccattgtagtgacgcagaaggcggcgctggcaaactgatttttaaggcgactgatgagtcgccttttttttgtctgtagaaaagtaagatgaggagcgaaggcatgaaaccatatcagcgccagtttattgaatttgcgcttagcaagcaggtgttaaagtttggcgagttcacgctgaaatccgggcgcaaaagcccctatttcttcaacgccgggctgtttaataccgggcgcgatctggcactgttaggccgtttttacgctgaagcattggtggattccggcattgagttcgatctgctgtttggccctgcttacaaagggatcccgattgccaccactaccgccgtggcgctggcggagcatcatgaccttgacctgccgtactgctttaaccgcaaagaggcaaaagaccacggtgaaggcggtaatctggttggtagcgcgttacaaggacgcgtaatgctggtagatgatgtgatcaccgccggaacggcgattcgcgagtcgatggaaattattcaggccaatggcgcgacgcttgcaggcgtgttgatttcgcttgatcgtcaggaacgcgggcgcggcgaaatttcggcgattcaggaagttgagcgtgattacaactgcaaggtgatctctatcatcaccctgaaagacctgattgcttacctggaagagaagccagaaatggcggaacatctggcggcggttaaggcctatcgcgaagagtttggcgtttaacgaaactcgccggatgaaaagtcatccggcgtcatattactgcaactgtgcggcaattagcggccagcgggcgtcaaaatcatccgttgggcggtatttaaactcgctgcggacaaagcgtgatagcataccttcacagaaggccagcaactggcttgccagcagggtttcatcggtggtgtaaccttcaccctcacgcattctcttttcacgcaatacctgacgcaactgcgcttcaatacgctcgaacagctggttgatgcgcccttgcagacgatcctgttcgaacattagcgcatgaccagtgaggatgcgagtcaggccaggattacgctcaccaaaaccgaggagcaacaacacgatcagacgcaggcgcgctgtggtgtctttctcatctttcagaatcagattgatgcgagtaatcaggctatcttcgataaactcaatcaggctatcgaacatgcgggtcttactggggaagtggcgatacagtgccgcttcggaaacgccgacagaggcggccagttttgccgtcgtgatacgttggcttccatcgctggattccagcatcagcgccagagactgaagtatttcctcgcgacggttccttttcgcagtttgtttttctgccatgttacaaaatacccctgaaaataagcaattgccaggcggcacccacgctatgaccgcaaacgaaatgtttgcggctatgttatgacgttattcggatgcgtatgtgttactgacgaccagagtgaccaaagccgccttcaccgcggtcggtggcgtcgaaatcttccaccagattaaattcagcctgtactaccggaacaaaaatcatctgggcgatgcgttcgccaggttgaatggtgaagctgtcctgaccacggttccacacggaaatcatcaactggccctgatagtcagaatcgatcaatcctaccaggttaccaagcacgataccgtgcttatgtcccaatccggagcgcggcagcatcattgccgccagtgaaggatcggcaatatgaatcgccagcccggtcggaaccagcgtagtgtcacccggagccagttctacggcgtcgtcgagacaggcacgcaggtcaagtccggcagagccagaggtggcataagtcgggagcggaaattccttcccaacgcgcgggtccagaatcttaacgtcgatttttttcatcataacgggtcacgatctcgtcgagtaataattggccaaggagctctttgcgctcaagcggtaagactttatctccgtcctgccagaaaaggtgtaatgcgttgttgtcgctgttaaatccttgagttggctgggaaacatcgttcgcgcagatcagatcaaggtttttacggatacgtttttgccgggcgtattcttccacattatttgtttcggcggcaaatccaacgacgtagggtcgatggtcttttagtgcggcaacgcctgcgacgatatcggggtttttaaccatttttattgttaattcatcaccctgcgtggcctgctttttgattttttctggggccacggtagctgcgcgataatccgccacggcggcgcaaccgataaaaatattttgctgctgtacagatgcattcacggcggcttccatttccagcgcagtcattacatcaacacgtttaacaaacggtggcgtcggtagcgaaaccggacctgataccagcgtgacgttcgcgccacgacgggctgctgcggcggcgatagcaaaacccatcttgccggagctgtgattagagatataacgcacgggatcgagcggttcacgcgtcggaccggcggtaatcataatgttcagatgtttcaggtcgttgacgggcgaaaaatgcgctaccgccatatccacaatggttaacggatcgagcattcgtcctgggccgatatcaccacaagcctgactgccgctgtctggcccccagatgagcaaaccacgcgaggcaagcacctctaaattatgctgggtggcggcggcacggtacatctgctggttcatggcggggagcacggctacaggcgcaggtgtagccagacaaatcgtcgataccaggtcattcgccattccggctgcaacacgggcaattaaatctgccgtggcaggggcgagaatcactaaatcagcccattttcccagctcaatatggcccatagcggcttcggctgccgggtccagcagactgtcggaaacgggataaccagaaaccgcctgcaagctaagtggggtgataaaggcttttgccgcttcggtcatggctacgcggacatcggccccgcgatcgcgcaaacgacgcaccagttcaggggttttataggcagcaataccgccgctaacgccgagaacgatttttttaccggccaggctcatgatgatttttcctgttgggtgacaccagaagttggcgattttatcacaatacttttgttgtcgtgccttcacctgagattcactttgcgaggcgctttccaggattgaaaactggccgtcgatttaaaggaacggctatgacaggatgcgagcaccacaaaggaggtgaaggtgaaaaacaatgcacagctgttgatgccgcgcgaaaaaatgctgaagtttggtattagcgccttaacggatgtcgagctgttggcgctatttctgcgtaccggaacgcgcggtaaagatgtattaaccctggcaaaagagatgctggagaatttcggctctctttatggcttgttaacctctgaatatgagcaatttagtggcgttcatggaattggcgtggcgaaattcgcccagttaaaggggattgccgaactggcgcggcgttactacaacgtacggatgcgtgaagaaagccctttactcagcccggagatgacgagggaatttttacaaagccagctcacgggcgaggagcgggagatctttatggtgatctttctcgactcccaacacagagttataacgcatagccgtcttttttccggcacgctaaaccatgttgaagtccatcctcgggaaattatccgcgaagcgataaaaataaacgcctcggcgctgatccttgcgcataatcacccttcgggttgtgctgaacccagtaaagcggataaactcattactgaacggataataaagagttgtcagttcatggatttacgcgtgctcgaccatatcgtgattgggcgtggagagtatgtttcttttgccgaacgcggctggatttaacccgctatgcgcgatccttcgggatctttgtctgttcgggacttgagcacatcgctgagtcagcgtatactacgccacctttgagaatctcgggtttggcatttgggcctggcaatcgagagttcacatagaactgcgatgaccgggctgtaaagcctgacgaggcgccaataccccatacgaagctcgagctaatttgatttttggagaatagacatgtcccgagtctgccaagttactggcaagcgtccggtgaccggtaacaaccgttcccacgcactgaacgcgactaaacgccgtttcctgccgaatctgcactctcaccgtttctgggttgagagcgagaagcgttttgtcaccctgcgcgtatctgctaaaggtatgcgtgtaatcgataaaaaaggcatcgatacagttctggctgaactgcgtgcccgtggcgaaaagtactaagtacttagaggaaataaatcatggctaaaggtattcgtgagaaaatcaagctggtttcttctgctggtactggtcacttctataccactacgaagaacaaacgtactaagccggaaaaactggaactgaaaaaattcgatccagttgttcgccagcacgtgatctacaaagaagcgaaaatcaaataattctcgctttgatgtaacaaaaaacctcgccccggcggggttttttgttatctgcttgcccccatattgactgcatctgttcattcctggagatgctatgcctgaattacccgaagttgaaaccagccgtcgcggcatagaaccgcatctcgttggtgcaaccattcttcatgcggtggtgcgcaacggacgcttgcgctggccggtttcagaagagatctaccgtttaagcgaccaaccagtgcttagcgtgcagcgccgggctaaatatctgctgctggagctgcctgagggctggattatcattcatttggggatgtctggcagcctgcgcatccttccagaagaacttccccctgaaaagcatgaccatgtggatttggtgatgagcaacggcaaagtgctgcgctacaccgatccgcgccgctttggtgcctggctatggaccaaagagctggaagggcacaacgtgctggcccatcttggaccggagccgcttagtgacgatttcaacggtgagtacctgcatcagaagtgcgcgaagaaaaaaacggcgattaaaccgtggctgatggataacaagctggtggtaggcgtagggaatatctatgccagcgaatcgctgtttgcggcggggatccatccggatcggctggcgtcatcactgtcgctggcggagtgtgaattgttagctcgggtgattaaagcggtgttgctgcgttcgattgagcagggcggtacaacgctgaaagattttctgcaaagtgatggtaaaccgggctatttcgctcaggaattgcaggtttacgggcgaaaaggtgagccgtgtcgggtgtgcggtacgccgattgtggcgactaaacatgcgcagcgggcaacgttttattgtcggcagtgccagaagtaattgatgcgcgccggatggcataccatccggcataaactctacgctaacttcgccatcagcgcctgatggacattctccggcaggaaatgggtgacatcgccctgatggcgcgccacctctttcaccaacgatgaagagataaacgaccactctttcgacggcatcagaaacacactttccagctccggcattaagtggcgattcatatgcgccagctgcatttcatattcaaaatccgccaccgcacgcaggccacgaatcagcaccgtagcgtgttgattacgggcgaagttcgccatcaaatcactaaacccgaccacttccacgttccccagatgtgcggttgcctgctgtgccagttccacacgctcttcaagggtaaacatcggttttttactgggactagcggcaatcgccagaataacgtgatcgaacatctgcgtggcgcgcgtcacgatatcgatatgaccattggtaatgggatcgaaagtacccggataaatcgcccgtttttgcataacaacctcaatgcgttttcggtggcaggtaaggttccagcagttgaagcagacgctgtagtgcgccctggttttgatacagcacttcaacggcatgacggccatagaaactacggtaatcggcgtcggtgagtaaagaggaaacctcttttgcaagcgtagtggcatcggtaacggtaatcagcccgcttgcctgctccagccgcgcgcaaatgtctttaaagttaaacgtatgcggccccatcaataccgggatagcgtgtgcggccgcttccagcggattatgcccaccacgttcaaccagtgaaccgccaacaaaggcgagatcggcaatgccgtacagtaacatcaactcgcccatcgtatcgccaaccacaacctgcgtgctggtggaggggacttcccctgaagatcgtgtgatatagcttagtccagcctggcggacaaggttaatcgcatccgggaagcgttctggatgacggggtaccaggatgagcaataaattcgggaattgctgtaacaatgcctgatgtgcggcgatcaccacactctcttcgccttcatgagtgctggtggcaatccataccgggcggtgtggtgcccactggcggcgcagcgtcacggctttagcagccaactgcggcgttacagaaatatcgaatttcaggctaccggtaacggtcacctgattattttttgcgcccagcgccacaaaacgtgcaccatcttcttcattttgggcggcaatcagcgtaatacgacgcagcaagcggcggacgaatttacccagtttggcataacctgcggccgagcgggcagagagtcgcgcgttagcgatcaccagcggaattttacgtttatgtagcgccgcaatcaggttaggccatagttcggtttccataatcaacaccagtttagggtcgactttattcaggaaacggttgagtgcatcgggcaggtcatacggcagataaacgtgctgaacatccttcccgaaagccgattgtacgcgctccgaaccggttggagtcatggttgttacggtaatcggtaaatcaggataacgatgacgcagtgcgcgcaccaacgggatcgccgccagagtttcaccgacggagacggagtgcagcataatgccgcctggttttagcggatggcggtaaaaaccgtaacgttcaccccagcgttttcgataggccggagccttacgtccgcgcacccagagccgtatccagatcagcggctgaataaggtagagaagggcggtgtaaagcaattcgagcatagtaaatagctgacttatggatgtgctggggattctatgtatttagctgtggctttaccattacttttcccgtttttgacttaaatagcaatttacccgccaattcttgctgaacatctatactttttttgtatttttatgcgattcattgatttctgcagtacgtgcaggaaggaatcgcagagcaacagtaaaagaatatggttgctaatgattttatttgattgatttctttattgaaaatcaacaatgtgcttaaaaatcattcgagtcggattgccgcgaaagaagtgatacactagcgcgtcaatatcagtgcggtatcagtattcaggtagctgttgagcctggggcggtagcgtgctttttctgcttcaccttaatcggataatctcaacaaaaagagttacttgtggataagccatttcgaagaattttgctcattaagatgcgttttcatggggatatgttattaactactcccgtcattagttcgctgaaaaaaaattaccctgacgcaaaaatcgatgtgctgctttatcaggacaccatcccgatcctgtctgaaaatccagagattaacgcgctctacggcataaaaaataaaaaagcaaaagcctcagaaaaaattgccaacttttttcatctcatcaaggtattacgtgccaataagtatgaccttatcgttaatcttaccgatcaatggatgattgctatactggttcgtttattaaatgcccgtgtgaaaatttcccaggattatcatcatcggcagtctgctttttggcgtaatagtttcactcatttggtgccgttgcagggtggaaatgtggtggaaagtaacttatccgtgctgacgccattgggacttgaatcgttggtgaagcagacaaccatgagttacccgcctgcaagctggaaacgtatgcgtcgcgaacttgatcacgctggtgttggacaaaattatgtggttatccaacctacggcgcggcaaatcttcaaatgctgggacaacgccaagttttccgctgtgattgatgccttacatgctcgtggttatgaagtcgttctgacgtccggcccagataaagacgatctggcctgcgtcaatgaaattgcgcagggatgccagacgccaccagtaacggcgctggccggaaaggtgaccttcccggaacttggtgcgttaatcgatcatgcgcagctgtttattggcgttgattccgcaccggcgcatattgccgctgcagttaatacgccgctgatatcgctgtttggtgcgacagaccatattttctggcgtccctggtcaaataacatgattcaattctgggcgggagattaccgggaaatgccaacgcgcgatcagcgtgaccgaaatgagatgtatctttcggttattccggcggcagatgtcattgcagctgtcgataaattacttccctcctccacgacaggtacgtcgttatgatcgttgctttttgtttatataaatattttccctttggcggtttgcagcgcgattttatgcgtattgctcagacagttgccgcccgaggtcatcatgttcgggtttatacccagtcgtgggaaggcgaatgccctgatgtatttgaactgatcaaagtgccggttaaatcgcataccaatcacgggcgcaatgcggaatattttgcctgggtgcaaaaacatttacgtgaacaccccgtcgatagagtcgttggatttaataaaatgccggggctggacgtttattatgccgctgatgtttgttatgccgagaaagtagcgcaggagaaaggctttttctatcgcctgacgtcacgttatcgccattatgccgcctttgagcgggcaaccttcgaacagggcaagccgacacagctgctgatgctgacagataagcaaatcgccgatttccagaaacattatcagactgaagcggagcgttttcatattctgcctccggggatttatcctgatcgtaaatatagccagcagccagccaatagccgtgaaatcttccgtaagaagaatggaataaccgaacaacaatatttattgttgcaggttggttcagacttcacgcgtaaaggtgtcgatcgttccattgaagcacttgcttcgttaccggattcgctgcgccacaacacattactatatgttgttgggcaggataaaccgcgaaaatttgaggcgctggcagaaaaacgcggcgtgcgcagtaatgttcacttcttctcggggcgcaacgatgtctcggaattaatggcggcggcggatttattacttcatcctgcctaccaggaagcggcgggaattgtgctgctggaagcgataactgcaggattaccggtactaacaacagccgtttgtggctatgcgcattatattgtcgatgccaattgcggcgaggctattgctgagccattccgccaggaaacattgaatgagattttacgcaaagcgttaacgcaatcttcattgcgccaggcctgggcggaaaatgcgcgacattatgctgatacacaagatttatacagtctgccagagaaagcggcggacatcataacgggtggtctggatggttgaacttaaagagtcgtttgccacgttatggcgcggtaaagatccttttgaggaagttaaaaccttgcagggtgaggtatttcgtgaactggaaactcgccgcactctgcgctttgaaatggcgggcaaaagctattttctcaaatggcatcgcggcacgaccctgaaagagataatcaaaaatttactctcattgcggatgccagtattaggcgcagaccgcgaatggaatgcgattcatcgactgcgggatgtcggcgttgatactatgtatggggtggcattcggcgaaaaaggcattaatccgctgaccagaacctcgtttattattaccgaagatctgacaccaaccatcagtctggaagattactgtgctgactgggcgaccaacccaccagatgttcgcgtaaagcgtatgcttattaagcgtgtcgcgacgatggtgcgcgatatgcatgctgcgggcattaaccaccgtgactgttatatctgtcatttcctgctgcacttgcctttttccggtaaggaagaggagttaaaaatttcagtaattgacctgcaccgggcgcagcttcgcacgcgcgttccacgtcgttggcgcgataaagatcttattggactttatttttcttcgatgaatattggcctgactcagcgggatatctggcggtttatgaaagtgtattttgtcgccccgcttaaagacattctcaagcaggaacaagggctgctgtcgcaagcagaagcaaaagccacaaaaatcagggaaagaacgattcgaaaatcgttgtaatttccggagagaaatatgagtgcccactattttaatccacaagagatgatcaataagacaatcatcttcgatgaaaggccagaggcgtcagtggcatcatcattccatgttgcttatggcattgatcagaactttctttttggttgtggtgtttcaatcacgtcagttttgttacataacaacgacgtgagttttgttttccacgtttttattgatgatatccctgacgccgatatccagcgtttatcccaattggcgaaaagctatcatacctgtatccagatccatctggtaaattgtgaacggcttaaggtattaccgacgaccaaaaattggtctattgccatgtatttccgttttgtaattgcagattactttattgatcaacaagataagatcctgtacctggatgctgatatcgcctgtcagggaaccttaaaaccgctgataacaatggatcttgccaataacgttgctgctgttgttactgaacgcgatgctaactggtggtcgttacgggctcaaagtctgcagtgtaatgaacttgaaaagggttactttaattcaggtgtcctgttaattaatacactagcgtgggcgcaggagtccgtttctgctaaagcgatgtcgatgcttgctgataaagccatcgtttcccgtttaacctatatggatcaagatatccttaatcttatcctgttagggaaagttaaattcattgatgctaaatacaatacgcagtttagtttaaattatgaattaaaaaaatcatttgtttgtccaattaatgatgaaaccgtattaattcattatgtcggcccgacaaaaccctggcattactgggccggttatccaagtgcgcaaccttttatcaaagccaaagaagcatcgccctggaaaaatgaaccgttaatgcggccagttaactcaaattatgctcgttattgcgctaagcataattttaaacaaaacaaaccaattaacgggataatgaattatatttattatttttatttaaagataataaaatgatattgagaaaagttaaatgaatgaatttataaaagaacggttttcgtatttagcagataataaaaaagaaaacgtcccagagctaaatgtttcctacggtatcgataagaattttttgtatggtgctggcgtttcaatttcttccgttttgattaataattcagatattaattttgtctttcatgttttcactgattatgtggatgatgattatttaaagtcatttaatgaaacagcaaaacaatttaatacctcaattattgtatatttaattgacccaaaatactttgctgatctgccgacgtcacagttttggtcgtacgcgacatacttcagggtattgtcctttgaatatctgagtgaaagtatttccacactgctgtatctggatgccgatgtcgtttgtaaaggaagtctgaaacctctcacaaaaattatatttaaagatgagtttgctgcggttattcctgacaatgatagtactcaggcggcatgtgcaaaacgtcttaacattcccgaaatgaatggacgttatttcaatgcaggcgttatctatgtcaatcttaaaaaatggcatgaagcaaatttgacaccgtatttactcacgcttttacgaggggaaactaaatatggctctcttaaatatttagatcaggatgcgttgaatatcgcatttaatatgaataatatctacctcgcgaaggattttgatactatttataccctgaaaaacgaacttcatgatcgtagtcatcgaaagtatcagcaaaccattaccgataaaacagtattgattcactatacagggataactaaaccatggcatagctgggctggatatccgtctgcatcatactttaatatcgcgcgtgaacaatctccctggaagaaatatcctcttaaagaggcgcggactgttgcagaaatgcagaaacaatataagcatctgtttgcccatggtgagtatattaaaagtataacttcattaattaagtacaagcttaagaaataaattactcttatgattacaagtatacgctatcgcggcttctcattttattacaaagataacgataataaatataaagaaatctttgatgaaatactggcctataattttaaaacagtaaaagtattacgtaatattgatgataccaaagtatcgttgattgatacgaaatatggtcgctatgtttttaaagtctttgccccgaaaacgaaaaggaatgaacgttttttaaaatcttttgtaaaaggtgactactatcagaatttgatcgttgaaaccgatcgtgtcagaagtgcaggtcttacttttcctaatgatttttattttctggctgagcgtaaaattttcaactatgccagtgtttttatcatgcttatcgagtatgtcgagggcgtagagctcaatgatatgccgattattccagaagatgttaaagcagaaattaaggcttcaatggaaaaattgcatgccttaaatatgctatcgggcgacccacaccggggtaactttatcgttagtaaagatggtgtcaggataattgacctatccggtaaaagctgtacggcagagcggaaagcccgtgatcgtctggccatggaacgtcacctgggtattgccaacgaaataaaagattatggctactattcagtaatctacagaaccaaactacgcaaatttattaaaaaattaaaaggcaaagcgtaaaccacacagtcaaaacggaaccaacatggatttattagctgagagtattactgaagtcgctgtctctggggaaattgctaacaccgatcgtgtgttaaatatcgcttacggtattgaccgcaactttttatttggtgcggcagtatctatgcaatcagttgttatgcataacccggaccttgcggttaagtttcatctctttactgactacattgatgaagattatctacaacgtgttaatgcttttaccagcaaaaatgctaacgttgaagtaagaatttataaagtatccagtgcctttattgatatcttccccagcctgaaacagtggtcttatgcaacattcttccgtttagttgcgttccagtatctgagtgaaactattgaaaatctgttatatatcgatgctgatgtcatctgtaaaggctcattagctggattgcttgatattaattttgatggtgataagttcgcggctgttattaaagatgtgccttttatgcaggaaaaaccagcgaagcgtctggctatagagggacttccagggaattatttcaacgccggtgtagtatatctgcagcttgaagcatgggcgaaaaatgattttatgaataaagccattgctatgctggcaagtgacccgcagcacacgaaatataaatgccttgatcaggatattttaaatattctgttctttagtcattgtatttttattagcggcgattatgattgcttttatggcattgactatgagttaaaaaataaaagcgatgaagattataaaaagaccattaccgatgatactaagctgattcattatgttggcgtaacgaagccctggaacgactggacgaattatccctgccagaagtattttaatgaggcttatcaggtttcttgctggaatgatgtggcgtttattccagccacgaatgaaaagcagtatcaagtgaaataccaacatgcaaagaaaaatggtgatacgtttaacgcttttatttacttcattaaattcaaattaaataagtataaaagaaaactatttgggcaataataaaaatcatggatgtctgagttacaataataattaatgatgagtactataatattttattagttcaggcaagagaacacgatgagcaatgattaccctttagtatccataataataccgacgtataattcatctgattacattactgaaactctaacgaaattagaaaaacaaacttacccaaattttgaaattgttattgttaatgatggttctaaagataacacatcaaatgttttgagagagtatgggttaacccactctcgattaattattctcaataaagaaaatggcggtgtttcgtctgccaggaatacaggtatccgcaaggcgcaaggacagtttatatgttttatggatgatgatgatgagatagatcctaactatctgctgaagatgtattccagacaacatgagacgggaggggatgcgatttattgtgggctttatggccatcatataaaaaatggtgttacttactcacctataaatacagattttaatgaagggtctttacttttcgattttttttataaaaaggtcagattccatatagggtgcttgtttataagaaaacaactcctggaagataataatcttttttttgatgaagatttacgactaggagaagatctggattttatctatcgactgctaattacatgcgatatgtatgcggttccatattatatgtataagcataactatagagaaaattccttaatgaactcatgtagaaccatcactcattatcgacatgagtcatttgcgcacgaaagaatctactcttctgtgatgcagttatacaaaggtaaccggaaagaagaaattcatacattattgagtaaaaatagaatttatcataaaactcgttatttatggaatgttctacttaatggcgattttgaattattaaatcaattagttgaaagcaatgaaaaagaattgaaagattgtaatcttcttggcaagagagataagaggcgagcaaaaatattagcatcaaaaaactatattctctgggggatggtaagactggtaagtagaaaaaagaataaacgttaggtcttgcattaaataacccatcctcgtaacataggttgaaattatatgtcgttttgttggaatgaaattaattctggtgtcaagtctttaattctcatattatgtatgttgtctttaatgactttgtctttgtgggatgatgttgcaacaaagtttcttcatgcagctggaattatatctgcattatattttctagcgtcaccaaaaaaaataataactaataatcctactttgttaattttcatctcattatgtcttttgggtatcgttaatatcatctggtattcacattataaagtttcaggctcggtttataccaatgcatatcgtggcccaatggaaactggaaaaattgccttgtgtagtgcttttattttcttagttctttttgctaaagatgagatgagaaccaaaataaaatttgggaaactaattctgttcgcatccttggcaacgcagttacttttttttgcgcatgccatgtggcaacatttctatttaaacgtcgaccgtgttgcattatcagcttcccacgctacaacagcaggctacatcatccttttcccttctttactggcatcaattctcattttaaaatccgactttagacataaaacaacattatatacaattaacttcatgcttagcttatgtgctgttatagtaactgaaacgcgtgcagccatattagtgtttccattctttgcgttactattaatcgtaatggatagttatattaataagcgaattaattataagttatattgttttattgcgattgcattattagcaggtgtattttcttttaaagatacattacttacgagaatgaatgacttaaatagggatttagttaattattcgcatgataacaccagaacttcagtcggtgcccgtctggcaatgtatgaagttggtttaaaaacatattctccaataggacaatcactggaaaaacgtgcggaaaaaatacatgaactagaagagaaagagcctagattaagtggcgctttaccctttgtagattctcatttgcataacgatctcatagatacgttatcaacgcgtggtattcctggagtagcattaacaattttagccttttcagcaatattcatatatgccttaagaactgctaaagaaccttatattttaatcttgcttttttcactactggtagtaggcctaagtgatgtaatactcttttctaaaccggttccgactgctgtgtttgtcaccataatattgctttgtgcttattttaaagtacaatcggaccaatgtttattagataagtaatgaatatgtgaaataaaatcagcaaggaagctgattttatttcaaaattatctattaaagagttgtaatttaaatcatggcagctttttcagcgttttcttcaatgaattgcttaacagcatttgctgtcaattgagacaactcattccccggagccctacaaaccatctgattcttcccatacccaccaattaatcccggatcggtaggtccataaaccgtgatattgggtctatccagtgccgccgttaaatggcttaaccccgtatccaccgacactacaaatttagccccagccagtacgcgggcaacgccttccagactcatcttcggcaatacttcaacataagcaaatccttccgccagtcgtttcgcccgttcttcctcatgcggcgcgccccacggaagtttaatccgtattcctgaatcagccagtaaaccaatcaattctcgccagtgttcttccggccagtgtttatcatctcgggttgttgcatgaagaaatacggcatattcgccagcatctgtaggcaggttcgtcaggaaatgctgtgcgatagcataatcgccctgggtttgtggtttgctatagcccagacttttggcaaacagttcgcgggtgcgttctacggcgtgctgctgttttgcaatatgatgtttacgattgtaaaacaggctggctaacggttcgcgagcggtttgccagtccattccatgctttacgccatgcgccagacgcgtcaccagcgccgcgctttttaccagcccctgggcgtcgataactgcgtcatagttctttgcttgtagcgcttcacgaaacgctttgcgttcagcttttatgggagccgagaaccaggctttacgccagcgacgtattgccacaggaataactcgctcaacggcagcgtgccaggaaggaatctgtgcgaacccttcttccaccacccagtcaaacttaatccctgggattgcctgctgggcatcagtgagtgcgggcagcgtgtggagaacatcgcccatcgacgatgttttaacgatcagaacccgcatccgtcaggcttcctcttgtaacaatagcgcgttgagttcttccagtacgcgctggggagtaatgtcgatcaagctctggtgataaccctccgcagcgtcacctttacgcactttgtgatagccggtaatcaggcggatcacgcgtgctttatgggatagcggtggtgtgaagtccgggctgcttggtccatacagggcaaccagcggacgattgagcgccgccgcaacgtgcatcagaccagaatcgttagtaacaatggctttacaggctgcaatcaggataaccgcttgatcaagctgtgtttctcccgccagattccgacaccatgcctgctgctctgtattcaaagcggcaagaatctcattgcccgcctcatgatctttcgccgagccaaacagaaccacctgataaccttcatcaatcagctgctttgccagctccgcatagtggtagtgtggccagcgttttgccggaccaaactccgcacccgggcaaaaaccaatcatcggacgttctgatgaaagcgaaaattgattacaggtatatgatttttcaccttcgctcacctgcaactgcggccataacaatggctgcggcagatcttgtgcggtacgcataatacctttgtcataggccagcgcgacatagcgttccaccattagcggccaggcttctttatcgagcacgcgtacatcgttgagtaaaccgtagcgcatctcgccgcgccagccggtgcgatgaggaatacctgcgaagaaaggcactaatgcggatttgaaggagttaggtaagacgtaggcgcggtcgtagcgcttttcacgcagactatgacccagtttgcggcgttcgccgatttccagcgctccgtgaccgagaggcatagggatcgcttcgttaacttccggcatccgcgataataatggacggcaccatgccggtgccatcacgtcgattatcgcctggggatagcgcgcctggagcgtgcgatagagactttgcgacatcatcatgtcgccaacccaagacgggccgatcaccagtattttcatgcagagctcttatgcgtcacgattcagccaggccatgtattccgttacgccttcggcaacggttttgaacggtttatcgtaacccgccgcgcgcagattcgtcagatctgcctgagtgaacgcctggtagcggcctttcagtttatccgggaacggaatgtattcgatttggcctttcttgtgataagcaagcgtagcatctgctactgcctggaaggattccgcacgaccggtgccgaggttgaagatgccggaaacgccattttccaggaaccacaggtttacatctgccacgtcgcccacatagacgaagtcacgtttaaagttctcgctaccttcgaacagcttcggtgattcaccgttattaagctgggtgttgagatggaaagcgacgctcgccatgctgcctttatggccttcacgcggtccataaacgttgaaataacggaagccaacaatctgtgagttcgcttcaggcaggatttggcgaacatattcatcaaacaggaattttgagtaaccgtagacattcaacggtttttcatattcgcgggattcaataaagtcggaggtgcgtccaccgtaagtggctgcggaagaggcatacaggaacgggatttcgcgctccagacagtagtgcagcagctctttggagtattgatagttgttatccatcatatacttgccgtcccactcggtggtggaagagcacgcgccttcgtggaaaatcgcttcgacatcgccgaactcttcgccagccataatctggatcaggaagtcttccttatccatatagtccgcgatatccagatccaccaggttcacaaacttggtgccgtctttcaggttgtccaccaccagaatatcggtgatgcctttatcattcagggctttaacgatgttgcttccgataaagcccgcgccgccggtaacgatgatcataactgtaaccttcgaattatggagtcagagacaatctcagacacgaatacttctatcatatcactacatgacgttggcttcagccattcaccaaaagtgagggggctggacgttatttatcctgaattttgcagaagtgttaacgcgtcatctcgtcgcgacctataagtttgggtaatatgtgctggaatttgccctgtctggagaatcgcaatgcgtggagaattttatcagcagttaaccaacgatctggaaaccgcacgggcggaagggttgtttaaagaagagcgcattattacgtctgcgcagcaagcagatatcactgtggctgatggaagccacgtcattaacttttgtgccaacaactatctcggactggcgaatcatccggatctgattgcggcggcaaaggcgggaatggattctcacggtttcggcatggcttcggtgcgttttatttgcggcactcaggacagccataaagagcttgaacaaaaactggcggcattcctggggatggaagatgcgattctctactcttcctgctttgatgctaacggcggcctgtttgaaacgctgctgagcgcggaggacgccattatctccgacgcactgaaccacgcgtctattattgatggtgtgcgtctgtgtaaagctaaacgctatcgttatgccaacaacgatatgcaggagctggaagcacgtctgaaagaagcgcgtgaagccggtgcgcgtcatgtgctgattgccaccgatggtgtgttctcgatggacggcgtgattgccaacctgaagggcgtttgcgatctggcagataaatacgatgccctggtgatggtagacgactcccacgcggtcggttttgtcggtgaaaatggtcgtggttcccatgaatactgcgatgtgatggggcgtgtagacatcattaccggtacgttgggtaaagcattgggcggggcttctggtggttataccgcggcgcgcaaagaagtggttgagtggctgcgccagcgttctcgtccgtacctgttctccaactcgctggcaccggcgattgtcgccgcatccatcaaagtgctggagatggtcgaagcgggtagcgagctgcgtgaccgtctgtgggcgaacgcgcgtcagttccgtgagcaaatgtcggcggcgggttttaccctggcgggagccgatcacgccattattccggtcatgcttggcgatgcggtagtggcgcagaaatttgctcgtgagctgcaaaaagagggcatttacgtcaccggtttcttctatccggtcgttcctaaaggtcaggcgcgtattcgtacccagatgtctgcggcgcatacccctgagcaaattacgcgtgcagtagaagcattcacgcgtattggtaaacaactgggcgttatcgcctgagggtgtgagatgaaagcgttatccaaactgaaagcggaagagggcatctggatgaccgacgttcctgtaccggaactcgggcataacgatctgctgattaaaatccgtaaaacagccatctgcgggactgacgttcacatctataactgggatgagtggtcgcaaaaaaccatcccggtgccgatggtcgtgggccatgaatatgtcggtgaagtggtaggtattggtcaggaagtgaaaggcttcaagattggcgatcgcgtttctggcgaaggccatatcacctgcggtcactgtcgcaactgtcgtggcggtcgtacccatctgtgccgcaacacgatcggcgtcggtgttaaccgtccgggctgcttcgccgagtatctggtgattccggcgttcaacgccttcaaaatcccggacaatatctccgacgacctggcttccatttttgatcccttcggtaacgccgtgcataccgcgctgtcgttcgatctggttggcgaggatgtgctggtctctggtgcaggtccgataggtattatggctgcggcggtggcgaaacacgttggtgcacgcaatgtggtgatcactgatgttaacgaataccgccttgagctggcacgcaaaatgggtatcacccgtgcggttaacgtcgctaaagaaaaccttaatgatgtgatggcagaactgggcatgaccgaaggctttgatgtcggtctggaaatgtccggtgcgccgccagcgtttcgtaccatgctcgacaccatgaaccacggcggtcgtattgcgatgctgggtattccaccgtccgatatgtctatcgactggaccaaagtaatctttaaaggcttgttcattaaaggtatttacggtcgtgagatgtttgaaacctggtacaagatggcggcgctgattcagtctggcctcgatctctcgccgatcattacccatcgtttctctatcgatgatttccagaagggctttgatgccatgcgttcgggccagtccgggaaagttattctgagctgggattaacacgaacaagggctggtattccagcccttttgcctgaggataatccgttaaatatgtaaaatcctgtcagtgtaatcaagagttcgtaattgcgctgatctcttatatagctgctctcattatctctctaccctgacgtgactctctcaccggtaaaaataatatctcacaggcttaatagtttcttaatacaaagcctgtaaaacgtcaggataacttcagaggtcgtcggtaatttatgatgaacagcaccaataaacttagtgttattattccgttatataatgcgggcgatgatttccgcacttgtatggaatctttaattacgcaaacatggactgctctggaaatcattattattaacgatggttcaacggataattctgttgaaatagcaaagcattacgcagaaaactatccgcacgttcgtttgttgcatcaggcgaatgctggcgcatcggtggcgcgtaatcgtgggattgaagtggcaacgggaaaatatgtcgcttttgtcgatgctgacgatgaggtgtatcccaccatgtacgaaacgctgatgaccatggcgttagaggacgacctcgacgtggcgcagtgcaacgctgattggtgttttcgtgaaacgggtgaaacctggcaatccatccctaccgatcgccttcgctcaaccggtgtattaactggtccggactggctgcggatgggactttcttcccgccgttggacacacgtggtctggatgggggtttatcgccgcgatgttattgttaaaaataacattaaatttattgccggattacatcatcaggatattgtctggacaacagaatttatgtttaacgcgctgcgtgcgcgatataccgagcaatcattatataaatattatctgcataatacgtcagtgagtcggttgaacagacaagggaataaaaaccttaattatcaacgtcactatattaagattacccgcctgctggagaaattaaatcgaaattatgctgacaaaattacgatttatccggaatttcatcagcaaataacctacgaagcattgcgtgtttgccatgcggtgcgcaaagagccggatattattacccgccaacggatgattgctgagatatttacttccggtatgtataagcgcctgattaccaatgtgcgcagcgtgaaggtgggttaccaggcgttactgtggtctttccgcttatggcaatggcgcgacaaaacgcggtcgcaccatcgcattacgcgtagcgcctttaatttgcgctagcgttaagttttgccgcttcgggctgtttgccccagccttgccactgatgctggaagtaaacgatcagcgtgctctggctgatgctttcgcttaatacttcaaagaagcgattagcataaacaggttccagcggcttcttcggtttgcacagcttcacgccacggaatggattacgcggtgtgtcgggcacagtgtttttcggcggtgtagacgtatcaacctgcggttcattcagcaagctgctggctttcaccagcgtaatgtctggcggcaggttataaaccatctgttgtagcacgcgtaccgttgaagggtgaggatgtccaatggcaatggttgaaccgttgcgacgcgctaggtcaattgcgcgattgaattgcacacggatgtccgcttcattttgcgaatcgtcgaggaacaccttccgtttgatcaccttcacgccagtgccttgcgcggcgcgcatcgcctgggtattaccgatggttacgctgtcgaggaagtaaagattgtaacgctccagcgcctgcatcactttctgcataccaaacaggttagaggtcatcttgctgcccatgtggttgttgatccccacggcatagggcacgttattgaccgcactacgaataatgcgctcaatttcgtcgctgctcatctccgggcgtagcgtatttttctccagcggctgtttactcagtggtgccatcggtagatgaatcaacacttcgtgaccgctgttatgtgctttggtcgccatctctctggcgtgcggtgaatcgggtaatacagcgacggagatagcggaaggcatcgccagcacctggttttcgttgtgcgggcgatacccaaaatcatcaatgacgatggcaagtttgccagcaattacgggggaggagagcgccaacagggcggcaaatgcaagaacgttacgacgaaatggaaacaaaacttatcttcccaaccacggctgtggattgaccgcctgaccctggcggcgaatttcgaaatagagtgaaggtctgccctgaccgccactgctgcccaccagtgcaatcggctggcccgcgcgaacctgcgaaccaacgctcaccagtgcgctctgattatagccgtaaagactcatgtcgcctttaccatgctcaaccaccaccaccagaccgtagccttgcagccagtcagccagaatcacccgaccgtcggcaattgctttaacttcagtaccttcagaggcaccgataaccattcctttccagcgtaattcaccctgtagctgctcgccatagcgatgcagcgtcggcccgcgaactggccagaatgcctgaccacgcggcgcacccagaccaccggtacgggacatcagcgatttttcgctttcggtcggcttgtaggtggtgcctttgcgcgtcgcttctttctggcggtcgcgaaccgcctgggcttcgcgcgcttcacgttcagcacgcgctttcgccgcggcttccgcacgggcaatgctgttacgcagacgggattcgttggcgcgcagttcgctcaactgttgctgaccttgctggatggaagactccagccctgccagtgttttcttacgctcgctcaacacctgggtcagcttcgcctgttgggcgcgctgctcatataaaagcgtttgttgctcgctctgtttctcttccagttcggcacgctgcatagcgacttcttcacgcgtttgtttcaactgagcaatggtttcttgtcgcgcctggttgagatagccgaaataagcctgtaaccgctgcccacgctggctttcttcaccgctgagaatcagctgaataccggtatgttcaccctgacgaaacgcggcatccagttgcgcggcgaggctgcgctcctgggcggctttttgctgctctagtttggcaatcgacgcgttcatctcatcaatctgtttattcaattgattaagcgtgttttgcgtttcgcgcagtttacgggtggcttcagagatcgcttcttcctgctttttcaattgtgcgagcaggcttgcgcgttgttgttgcttttggcgtaccgcgcgctctttcgcggcgatgtcagcctgaatggatttgagttggtcacgctcatccgcgtgggcggaaaaggcgcacaacaatacgccagcgctcagaacgctggcgtagatgatgggcctgattgcaaacctgcgcggtttcacggcccgtgtcatggtattaatcgcctttcccctcatggggagggattattccacgatgaacagcggcttaccagtcatctcttgcgggatttccatacccatcagcgacaacatggtcggcgcgatgtcagaaagtttgccgccttcaaccgctttcacgttcttatcaccaacgtaaatcagcggaactggcaggttggtgtgtgctgtgtgtgcctgacccgttgccggatcgcgcatctgttcagcgttaccgtggtcagcggtgatcagcagttgtccacccacggactcaaccgctttcgcgacttcttccacgcagtgatccagcgcttcaaccgctttaaccgccgcttccatcaccccggtgtgaccgaccatgtcgccgttcggatagttacagataatggtgtcgtatttgccgctcttgattgccgcaaccagtttttcggtcagctctgcggagctcatttccggttgcagatcgtaggtagccactttcggtgagttgatcagaatgcgatcttcgcctttgaacgactcttctacgccaccgttgaagaagaaagtaacgtgggcatatttttcggtttcggaaatacgcagctgagttttgtcgtttttcgccatccactcgccgaaggtgttaaccagggaagcgggtgggtaagccactgcggttttgatgtcggcagcgtattcggtcagcatcacgaaatcgacgttaaccactttcttacgcgcgaagccgtcaaaatcggcatttacgaatgcacgagtgatttcacgcgcacggtcagcacggaagttcatgaaaatcagcgcatcgccgtcttccattgccgcatctggctgaccttctgcacgaataacggtcgctttcacgaactcgtcgttttcgtcgcgagcataagcagcctgcaaaccggcaacggcggtatcggcctggaactcaccttgcgccagagtcagcaggtcataagctttttcaacgcgatcccaacggttatcgcggtccatcgcgtagtaacgaccaatgatggacgctacgcggcctttacccagcgcggcaaatttctcttcgaattttttcagcgaggattcagcactgcgcggcggagtgtcgcgaccgtcaaggaatgcgtgtaggtagattttttctgcgccgcgttcagctgccagttctaccatcgccatgatgtgatcttcgtggctgtgtacaccacctgcggagagcagacccataatgtgtactgctttgcctgcgtttttcgctttatctactgcaccagtcaacaccggattagcaaagaaagcgcgatctttgatttcaacgtccagacgagtcaggtcctgatacacgatgcggccggcacccaggttaacgtggcctacttcggagttacccatctgacggtcaggcagaccgacttccagaccggaagcgtcgatcagggtatgcggacgattggcccacagtgcatccattaccggggttttagcactaaaaatggcgttatcctgctgttcttcgcgatagccatagccatccagaatcaccagtaccataggttttttagaaaccgacattgcgacaacctcatactcaagagtcaaaatttgcgtaattttactacagctgaatcgataaaatagcctctgaagatcaaaatatacgaccgctcgcggcaagcagatgccagatttacgcttttttttcgtagcgccccgcaaaattgcattccagttaacgcgctggctgtatttgccgcactgcgcaggtatactcctttcctggtttttttaatcactacgtcgggagttgttaccccccatgcaagaaattatgcaatttgttggccgtcatcccatactgagtatcgcctggatcgcgttactggtggcggttcttgtgactacgtttaagagcctgacctcgaaagtgaaggtgattactcgtggtgaagctacgcgtctgatcaacaaagaagacgctgtggttgtggatttacgtcagcgtgatgacttccgtaaaggccatatcgcaggttctatcaacctgttgccgagcgaaatcaaagccaacaatgttggtgagcttgagaagcacaaagacaaaccggttatcgtggtagatggttctggcatgcagtgccaggagcctgcaaacgcgctgacgaaagctggttttgcgcaagtattcgtactgaaagaaggcgtcgctggctgggctggcgaaaacttgcctttggtgcgcggcaaataatttacctgccgtttttcatgatgcaggccgttagctgcaattaggcccccagcgacttattgatataagcttctggggacactccattttgctgccgccctgcaacatgaaatttcagggtaaaaaacaggagctaatttatggccaatgttgaaatctataccaaagaaacctgcccgtattgccatcgtgcaaaagcactgctgagcagcaagggcgtgagttttcaggagttgccgatcgatggcaatgccgctaagcgtgaagagatgatcaaacgcagcggtcgcaccacggttccacagatttttattgacgcacagcacattggtggctgtgatgacttgtatgcattggatgcacgtggtggactggatcccctgctgaaataacgtgtgaacgttggcattacattgcgcagtattttaaggacaacacttaagggttttctacacatgtcagaacaaaacaacaccgaaatgactttccagatccaacgtatttataccaaggatatttctttcgaagcgccgaacgcgccgcacgttttccagaaagattggcaaccagaagttaaacttgatctggatacggcatctactcaactggcagatgacgtttacgaagtggtactgcgtgttaccgtaacggcctccctgggcgaagaaaccgcgttcctgtgtgaagttcagcagggcggtattttctccatcgcgggtatcgaaggcacccagatggcacattgcctgggcgcatactgcccgaacattctgttcccgtatgctcgtgagtgcatcaccagcatggtatcccgcggtacattcccgcaactgaaccttgcgccggttaacttcgatgcgctgttcatgaactatttgcagcagcaggctggcgaaggtactgaagaacatcaggatgcctgatgaaccaacgtaatgcttcaatgactgtgatcggtgccggctcgtacggcaccgctcttgccatcaccctggcaagaaatggccacgaggttgtcctctggggccatgaccctgaacatatcgcaacgcttgaacgcgaccgctgtaacgccgcgtttctccccgatgtgccttttcccgatacgctccatcttgaaagcgatctcgccactgcgctggcagccagccgtaatattctcgtcgtcgtacccagccatgtctttggtgaagtgctgcgccagattaaaccgctgatgcgtcctgatgcgcgtctggtgtgggcgaccaaagggctggaagcagaaaccggacgtctgttacaggacgtggcgcgtgaggccttaggcgatcaaattccgctggcggttatctctggcccaacgtttgcgaaagaactggcggcaggtttaccgacggccatttcgctggcctcgacggaccagacctttgccgatgacctccagcaattgctgcactgtggcaaaagtttccgcgtttacagcaacccggatttcatcggtgtgcagcttggcggtgcggtgaaaaacgtcattgccattggcgcggggatgtccgacggtatcggttttggcgcgaatgcgcgtacggcgctgatcacccgtgggctggctgagatgtcgcgtcttggcgcggcgctgggtgccgatcctgccacctttatgggcatggcggggctgggcgatctggtgcttacctgtaccgacaaccagtcgcgtaaccgccgttttggcatgatgctcggtcagggcatggatgtacaaagcgcgcaggagaaaattggtcaagtggtggaaggctaccgcaatacgaaagaagtccgcgaactggcgcatcgcttcggcgttgaaatgccaataaccgaggaaatttatcaagtattatattgcggaaaaaacgcgcgcgaggcagcattgactttactaggtcgtgcacgcaaggacgagcgcagcagccactaaacccagggaacctttgttaccactatgacccggcccgcgcagaacgggtcggtcattatcttatcgtgtggagtaagcaatgtcgtgtgaagaactggaaattgtctggaacaatattaaagctgaagccagaacgctggcggactgtgagccaatgctggccagtttttaccacgcgacgctactcaagcacgaaaaccttggcagtgcactgagctacatgctggcgaacaagctgtcatcgcccattatgcctgctattgctatccgtgaagtggtcgaagaagcctacgccgccgacccggaaatgatcgcctctgcggcctgtgatattcaggcagtgcgtacccgtgacccggcggtggataaatactcaaccccgttgctatatctgaagggttttcatgctttgcaggcgtatcgcatcggtcactggttgtggaatcaggggcgtcgcgcactggcaatctttctgcaaaaccaggtttctgtgacgttccaggtggatattcacccggcagcaaaaattggtcgcggtatcatgctcgaccacgcgacaggcatcgtcgttggtgaaacggcggtgattgaaaacgacgtatcgattctgcaatctgtgacgcttggcggtacgggtaaatctggtggtgaccgtcacccgaaaattcgtgaaggcgtgatgattggcgcgggcgcgaaaattctcggtaatattgaagttgggcgcggcgcgaagattggcgcaggttccgtggtgctgcaaccggtgccgccgcacaccactgccgctggcgttccggcacgcattgtcggcaagccggatagcgataaaccgtcaatggatatggatcagcatttcaacggcattaaccatacgtttgagtatggtgatgggatctgacattctgtgatcgtgccggatgcggcgtgaacgccttatccggcctaccgcatcttaatctctcaacaccgctcccggataccccagctggcgccaggcttcatacaccacgaccgacaccgcattggacaggttcatgctgcgactgtccggcaccattggaatacgaattttttgttcagcgggcagggcatcaagaatgctcgctggcaggccgcgtgtttccgggccgaacatcagataatcgccatcctgatagcttacggcgctgtgagcaggcgtacctttcgtggtgagggcaaacaggcgctggggattttctgcttcgagaaacgcgcgatagtcatgatgacgcgtaacggcggtaaactcgtgatagtccagccccgcgcggcgcaggcgcttatcgtcccaggcaaatcccatcggttcgatgatatgcagacgaaagccggtattagcgcaaagacggatgatgttgccagtatttggcggaatttctggttcgtaaagtacgatgtttagcatactgcccccttagtgcgggggcaggatagcagatattcgtctaacccttaagctgcattccctttcgccatcggagccagtgccgccggcaactctttacccagcccctgcaccagcgaatcttgcgtaatttcgctaatcgatttcgcgccagtcagcgtcattgccactttcatctctttttcgatcagattaagcagatttgccacgcccgcctggcccgctgttgccagtgcatacaggaaagcacgacccagcagtacggtgtcggcaccgagcgcaatcatacgcacgacatcaagcccgttacgtattccgctatccgccagaatggcgatatcacctttcaccgcatccgcaatagcaggcagtgcacgagcagaagagagtacgccatctaactggcggccaccgtggttagaaaccacaattccatcagcaccaaaacgtactgcatcgcgcgcatcttccggatcgaggatccctttgatcaccatcgggccatcccagaaatcgcggatccactcaaggtctttccatgagatggacggatcgaagttattccccagccagccgatgtaatcttccagtccggtcggtttgccgaggtaagccgagatattacctaaatcatgcggacgaccgttcaggcccacatcccacgcccattgcggatgcgtcaccgcctgcaaatagcgtcgcattgccgcgttcgggccgctcatcccagaatgagcatcacgataacgtgctcccggtgttggcatatccacggtgaataccagcgtcgaacaacccgctgcttttgctcgctccagtgcgttacgcataaagccgcgatcgcgcagcacataaagctggaaccacatcggacgtttgatagccggagccacttcttcaatcgggcaaacggaaaccgtcgagagagtaaacggaatgccatgcgcatccgctgctttggcagcctgaacttcgccgcgtcgcgcatacatgccacacaaacctaccggacctagcgccaccggcatcgacaatttctcattaaacagcgtcgtttccaggcttaagtcagacatgtttttcagaatacgctggcgcagcgccacttctgacaaatcttccacgttgcggcgcagcgtgtattcagaatatgcccccccatccatatagtggaacaggaacggcggcagaatgcgttgcgctgcggcgcgataatcgctggctgcggaaataatcatgcgtttttctccctcgaatgctcattatggtcaccaggcaggcgggtaatgcgtgcatggcgagcctgatcttcatcgaatcgtttcatggtggtgtgaacaaagctaaggtgcgccatcattgctttacgtgccccgtcagcatcaccggcaaaaatggcgtcaatgaccgcctgatgttgttcggtcagctgtgaaaaaaccgggggtatcaggtacatccgctggcggctatgcttcacagaggattgcaggacatcgaagaaaccgcgcatggtttgcagcagcacgatgttatgtgaggcttcggcaatcgccagatgaaaacgaacgtccgcttgtgaggcgagatccgggtcttcgctgagcgttgcttcaaaacaaagctgaatcttttctttttcgccaggcgtggcacgcattgctgcatgccatgcggtgctggcttcaatggcgtagcgggcttccagaatatcgaaactgtaatccggatcatcggccatcagcgttttcagcggctggacgatgttttgctccgaccatgtgtcatgacgccagcgaataaacgtcccgccgccacgtcgactgagcagcacaccttcgcttaccagtttcgccagcgcctcgcgcagtgaatttctcgacacgccgagttgcatcgccagttgacgttcagcgggcaacttcatgcccgcttccaggtttttttcatcaatcagcgcccgcacacgatcggcaacctcgtctgacaggcgtctgggtaaaacaatcattaaggaatcatccacgttaagacataggcctgaagcgtggtgatcacgcccaccatacaggtgaagatcaggctgtgtttgacagtaaagcggaacaaatcagactctttgcccaccaggcctaccgccgcacaggcgatagcgatagattgcggggagatcatcttaccggtgacaccaccggtggtgttggctgcaaccagcaacaggtcagaaacgccaatttgttgtgcggcggtagcctgcaaagcggcaaacaaagcattagatgacgtatccgacccggtcaggaataccccaagccagccgaggaacggcgagaagaaggtgaatgcatgaccggtgtgcgccagtgccagcgccagtgttgatgacaaaccggaatagttcgagataaaggcgaacgccagcaccatgccgatggagtagataggcagagccagttctttcagtgtgctgccgaaggtgctgatagcgtcagatggtttcatcttcagccagacaatcgagagcagggcagcaaacagaatggcggtaccggtggcagagaaccagtcaaacttaaacacggcggcatacgctgtcgcttcgctgaccactggcggcatacgggcaaccagtttatcgaggtacggcaccggaatgttgatcacccactcatacagcgcaccgcctgaagcgaacagggctttaaacggcgggatactccacagcgttacggtggcggtcaggaacaggaacggtgtccaggcgcgcagcacctgacctgccgtgtaaccggtgtgagccagcgtcatatcaacctgtgacgcccctaagtcaccgaagcggaatacgcgaactggttgccagcgtttgaggaacagtgtcagacagagcagcgataccagcgaagagataatgtctggcagttccggcccaataaagttagagctgaggtattgagcgatggcaaatgagccgcccgcaaccacgaccgcaggccaggtttctttgataccgcgccagccgtccataatcgccatgatccagaacagcacgataatggtcataaacggcagctgacgccccaccatctgaccaatctcaaagctgtcgatgcctgttacctgcccggcgaccagaatcggaatacccatcgcaccaaatgccactggcgcggtgttaacaatcaggcacagcccggcggcgtacagcggtttaaagcccaggccgaccagcaatgcggcggtaattgctaccggtgcgccaaagcctgcggctccttcaaggaaagcgccgaaacagaaaccgacgatcagcatttgcaggcgctggtcaggggttatcgaaagaatagacgagcggatgatgtcaaactgcccggttttcaccgagatcttatagacgaacaccgctgcaataatgatccacgcgatgggccacaacccgtagaagaagccataaaccaccgaggccagcgcgttagcgaccggcattttatagaacagcaaagccacggcaagggcgattgccaccgtccatgaggcggcgacgtatcctttcagtttgagcttaatcagcgcaaagaagaaaaacaggatgggaagcgatgctatcaggctggaaagccagatattcccggcgggatcgtagttttgttgccagagattcattgcaggtctcctgcagtccacacacgccgtgtaatgagtctgttgctcatctccttgtcacacgctgtgtaaaagtggcactgccaattgtgttgtgtagggataatgacaatggatagttaactaaatgttatgtattggcaatattgatgtgagttttaattggggaattgtgaaccagaggtcagataagcgaagaattggtagggccaatcctgggagagaggtaatgaagaaaagggcaattcccatcagagaattgccctcagattgttgatctggtgcgccttatcttgccggatgcggcgtgaacgccttatccggcctacagggtagtgctgaatcaccccgtaggcctgataagcgtagcgcatcaggcaatgtggcgtttacccattcgttaatggatgattaccactgaataccggcaccgagtgcggcggagtattcaccctggctattggtactaccttgtaatttgtagacccaacgaccattggcgctcaccatcgacacacctaaagcaactgccgattcaccgttgtaagtaccgccaccaatagacgccatgctggcacccggcgtgtaagcctgcggcagaccggtcattgccattgcagaagcgataccaccactcagtttgctttcagttttggacagtttgttatccatctcaaccatgcgctgatcggtgtattgcttcgtttcctgcacactttgcttcaactgcgcatagttcaccgcgtcgttgttattcacgccagcagaaacgttgctgatgcgagtcgtaccgctattgccgccaccgagagtgatgttgctgtagtcgatagagccatcagctttggtgtcgtagcgaacgccgcctgcttcagaagacttcagttgcgaaacgttaaccgcatcggtggcattaacaccggcagcaacgttggtgatacggcgctggttggtagaagaacccacagagatcgtattttcttcgtctgctacggaacccgtgcccagtgcgacgctgttgtcagcggcagcaatggaaccagaaccaatcgcaacactgtctttaccctgcgcgttggcgtctgcgccatcggtgttggtcttgaagtacttagtgctaccggtggttacgatatcgccgataccgttttcgatattggtgacgcgagtgtccagattcgttacctgattattcaggttagagatattctgggtgttttgcgccacacgctcatcggtaactttcaactgactaacgttgacggcatcggtatccgccgaacccgctgcgacgttggtgatctgacgttgaccgtcttcactgccgacagagaattcacccacagagttctgcggtgcatccatgttgtaggcagtgtagttggtctgcgcaccacgggtagtctgagaaccattacccattgcaatgctgtcggcatgatttgcgcgtgcgttagaaccgatagcaataccgttgatcgcatcagccagaaccagcgtgttcaggccgataccaatactcgcattaccattaacgatggttttcgcgcccattgccagcgagtcttcaccgactgccagtgagtcttcagccgttgagttggcgtgatagtatttggttggtgtggttgcgactgcaccaatggcgttctgcaactggcgaaccgtaacagcgtcatgggcttcagaaccatccgcgacgttgatgatttgacgatatttaccatcatcaccgatcgacaatgcgccaagcagttcgccatccgtggtgtcataaccaatcacaacaccttcttccgatacgctggtgtcacgagaacctttggtgattacgcggctggagacggagctgctacccagggcaataccggtatcaacggtgctgctgctaccttgaccaatggctacgctgctttcgcctgaggcgacagcgttataacccacagccgtagcgccaatacctgaagcgctggcatcgttgaacgctaagccgttgtcgttggtacgtacatagttaatacccgcaccgttatcttcgatgtaggtttcgctagtgttaccagcaagctggttaatcatttggctattttgcgtaaccagaatattggttgcgtttaactgggaaccgttaacagcatcggtactggttgtggagagatcaccagccgcaacgttggtaattttgctggcattgccatcatggctggcgttgtaggcacctgcgtcttcatcccacagcagagcgttattatcaagcgcatccagggcttcaccgacgttgttgtaatcggtatttgcaatggtgtaagtcggtgcagtgatagttccgtcagcgttgacttctgcatcaccacccagcgcatcagcgatgtacttattggtgctatagagctgtgagccattaatggcatcgctgctggtggcagagactgcaccgttagcgacgttagtgattacactggcagttttatctttcccgtgagcggcgctaaatgcaccgttaccgccattggctgtctcatcccacagcagggcgtcatccagcgtggtatcgatcgcttccagcgcgtcaccgacattgtcgtaactgccgcccgctatggcataagtcggtgtagtgatactgccgtctgcattcaccacagcgttcccgcccaaagcatcggcaatgtagtcactaacgccataaagttgcgaaccgttaatggcgtcgctactggtggacgagactgcaccgtttgcaacatcagtgattacactgggatcattattaatgccgtgtttggcgctgaatttacctgcggttgcatcccagagtagggcgtcgccgagtgatgagctaaatgatgtgttaatagctgccagagcatcaccgacgttagtgtagtcagtaccaccaatagtgtaggttggcccggttaatacgcctgcatcgctgatatcagcacccccaccaagatatgacgtaaatgaatccgctacgccataaagttgtgatccgttaatggcatcggtgctgtcagaagataccttgccagccagtaagttggtgatcttgctggtggcttcggtgccgtgcgcggcgctgaatgcgccagccgttttgttccacagcagggaatcgtccttaaggtcgccaacggaatccgtcaggttggtgatgttggtggtgttggtcgacacgttatcgttggtggttttgagctgggagccattaacggcgtcagtgctgccagcagtcaggtcgccagcggtaacattggtgatcttgctggtagcttcggtgccgtgtttggcgctgaatgctgtgccattccagagcagggcatctttttccagggtatcaacgtccgcgttcagagtagtgatactgctagcgtttgtagctatatcggcggtattagtcgcaatatccgtagtgttagtggcgatattggcagtgttatcggcgatattggcagtgttggttgcaatatccgtggtgttagtggcgatatcagcagtgttatcggcgatattggcagtgttggttgcaatatccgtagtgttagtggcgatattggcagtgttggtcgcaatatccgtagtgttatcggcgatattggcagtgttggttgcaatatcagcagtgttatcggcgatattggctgtgttggtggccacatcgtctttggtttctttcaactgggaaccgttaaccgcatctttactggtgtctgaaatagtaccatcttcaacattagtgattttgctggtggcttcggtgccgtgtgcggcactgaatgctgtgccgttccacaacagcgcatcctgctgcaggtcgtacaattgagagccgtttactacatcggtgctggttgcagaaaccgtacctttagcaacattagtgattttgctggtggtatcactaccgtgtgcggcgctgaatgcagtgccgttccacaacagagcatcctgctgcaggtcgtacaattgagagccgtttactacatcggtgctggtggcggaaatagtaccctttgcaacgttaatgattttgttttgggctatgctgctctttgggctgccatcagcgtttttgacgatatagctggcactaaatgctccctcggttttgtcccagtgcagagtgtcattgtcgattcccaaaagcgcctctcccacattattgtagatgccgcttttcagcttgtagcttggcgcatttacacttccatctccatttacgccagcaccagccccgagtcgggctgcgactgaggcacttaatgcatgaagttgtgaaccgttaatggcctcagtactgcctggttgtataagaccggcagccatattggtaattttgcgttgtgttgtgctgttccctaccgaaacggtattgtcttgctctgcgacagatcctacaccgagggcaactgcgttatcaccgtttgcattggattgactacccaaagcaagactgtttatgcctccagcaaaactattctctcccagcgcaacggagccctcaccagatgcagtgctgttactacccagggcgattgaattgattttacttgcgttactgagttttcccagtgcaatagcattttcagcattggtctcacttaactcacctattgcaaggctggagtcgccatatgcctgacttgtactacccagcgcaacggcgttatcaccagatgcattgctgttactacccaaggcaatggcattctccccagtggccaaggccacttttccgaaggcctgactacctttgccctccgctcttgcgtccttgcctatcgccgtggcgttttcagcgaaagccttagatccattccccagcgtaagggaataatcggcagtcgatttagctccactaccgattgctatggccctattaccggttgcgtcagctgtttgtcctaaagcaacagatctttctcctgtagcctggctcttgaaacctaatgaggtactacctatcccagattgggcttcttgccctattgcaatacttgatgttcctggtcctcctgatggtgaagtgtctactgatgatgctttagcaccctgaccaatggcaatccaggtatcggtcaatggagtgctttcgctagccccaccaccatcaagcgcggtcgatgcttgtactccagacgacaacaacccacccacaaccaacgcagaaattaacagcttactgcgcccgctttttttaccacgactttttgctgtttcactggcaacggtgtaactacctgttgccggattccagataactttaaatattttgttcattattgatgctctctattccttgatataagcgcagaagctgcatttattttttgtttttccgctgtggagattcagcaggttgaagacggtcgaactgaatatttgccatgttgatggctaatttcagatatttgaggttgttgggcgagacaccttttagcgtcaaattaatgtcttgccattgacctggtaataatttcagggaggagttcattgaggtactaaatagcaattgctgccattttgctaatgcgttgatgtcggtgggtttttctcccccccatgtcgcgtaaaaacccatatttgatacaggaacacttaataagttaaccagtgaaatacgaataacgctgccgttttctactgcgtcaatagacagtattttccctgccaaaccaacagaaccgttatttaaaatgaagtattgggtttgtgccgggttaaattctgtaaagacaaattcgtcctgtttgtctttaactgccttcaccacgccagcgagcgttttggtactgtttatgatggtagtttgttgtttttcaaagtgttctatcttgcgcttgtcgagttcttgttgtttttcaagcgcctcaattttgcttttttgtaactcttgctgtgtaacgagatcgtcgaccttactcgctttttcaatatagtcacaccctaccaataagcaaagttgcaatatcattaacacgcttaacagtgttttctttaggttcataggatgaattccttttcataatcccgatacagttgataattacggcacaatcattttttttatgaatgattggaatgaggcatatccgcaaaataaatttgttagagagtttttgtattaattggttgtgcgaatatgttattaaatgtcaaacgatttcagtttgtagccaataatattaatcgcgcggattttaatgatcggtgtcaatcgatgtcaaatgtttcaccggataaaggcacagggcagggaaaggtaaatattcagttgagtgatgttttattgtggaatttgcgaagctgattgaaaaatttaaataattaattatgtttcgagcattgatatgcggaaattcattgttgatattgatacatcattctttaatgtgtacctgattttcagaatttagcctgctacgatcgctcagaagtgtaggtggagttgaatatataatgttaagaacgttataaagattcgatctctgaaacaggctcctgcatgtgccagcaggagcgagtaaatggtgagaggctgtgattacagcgacgagaaaggaacttaaaacgcagtctttgagaaccctgtcatctcttgcaggcccatttcacggcccagcgcggtcattgggtgcacaaccaccagtccgcgaacactttttttcagtttgcccatatcagcttgctcttttttggtgattgcacgctggaacggcatcttcatcagtttctgcgcttctttgctgagtttctggctgtgaacttcgcgcaggcgagcaatttctgcttccagcgtggctttctctttttccagttcggcatatttgtctgcggcttcaaccagcgacagatcggcctgctggtgacggatggcgtccagacgatcgctgagacgtttgatttcgtttttttcgacttctttcatgtgatgacttctgatagagataaatttatagcctctagtatgcgcgaccaggtgctttgttcacaactgatggcattgtaatagttccagattgtaaccattaatgcgttaaaaaatcacccaatacattgattagttaagaaatttaaagaaaaaagatagtcaacagaagcaggtgattattgaggattgagcacgttttccttaatgtcatttataccgggatctaaactaaaattggcggccgcgcattcccggcgcggggtaatacggagatatcatcatgggcaaattaggtgaaaacgttccgcttcttatcgataaagccgtagatttcatggcatccagccaggcgttccgggagtatctgaaaaaactacctccccgtaacgcgattccgtccggaatacctgatgaaagcgtgccgttatatctacaacgtctggagtattatcgtcagctttatcgtccgaaacaggtagaggagaagtaagcgaaagtacttacttttgaaaggctttttttaagctgattttggaaatcagctctgtcagtgaaaggaccattgttgatcgcacagcctgttggtaacgctgaatttgcattgcatacaaactggagtctgcaggttcaaactgtggcggcggtggtaacgccgccacgcaatgcagttcaccaaagggtccaagtatttcgtcgtcggtaaaagcgtactcgttgccgtcgtgatttagctcttcacgcaatgccatcagcagttccgcatcttcgtattcctggcggttaatgacgcccaacccgtaaatgagttttaaacgcacagaaagatcgcccagcggaccatcgccgtcgagtaacggttctacagcatacttcaccgcgtaatcgtctttgcggaatacctgaagcaccagaagatttaccgcctcggtcaaaagctcgacggcggtgatcagaaagcttcgcacggttttgccagcattcagacgctcaagcacacggttttcaaaggcctgggtttgttccattgttgcctgcatatctgacaatctgttattcgggcgcagggtatcctgcgcctggtccaccattattgcattgctttataagcggttaccgcctcggatacaacctcgctgttggcatcaagaccggaaatctgtgccagcgcggcttgtgggcctttgtcggcaatcagcgctgccagttcctgagcctgcgggtcatcttcactgcggaagtgcattgcagcggcaataccttcaatcaggtttttatgtggcagaccatattccagggttccaagcagtggcttgatcagacggtcgccagcactcagtttacgcagcggctgacggcctacgcgttctacatcatctttcaggtacgggttctcgaaacgaccgaggattttctggatgtatgccgcatgtttgtcagcatcaaagccgtagcgcttgatcagtaccgcgccgctttcttccattgccccttttaccaccgcgcggattttctcgtcgagaattgcgtcacgaatggtctgatgaccggccagttttccgaggtacgcggttatagcatgacctgtattcagggtgaagagtttacgttcgacaaatgccatcagattgtcggttaattccatgccagggatgtttggcagcgtgcctttgaactgcgttttatcgacaatccattcgctgaaggtttctaccgtcacttccagcggatcgttagttgccgaagccgaaggcggtacgatgcggtcaacggcggaatcaacaaagccaacgtgttcttctacccacgctttggcatcttccggcagggcgttcatcacatggcctttcagctgcgtggtgccgcggaccatgttttcacaggcgatgatgttcagcggagattcattaccttgttctttacgtttcaccagccctttggcgatggccggagcaatacgttccagcacgacagggccaacggcggtagtgactaaatcgacctgagcaatcagatcaacgacatcatcgccaatgctgctgacggcattgacgccagaaacggtatccacctgctcggtttcaccaaccacatgaacctgatagctatgacgggcattcagggcatcaagtaccacctgatttacatcggcaaacgtcagttggatacccgcgtccgccagcagtttaccgataaagccacgaccgatattacctgcgccaaaatgtaatgctttcatagtattaaccttcatcaatgtttttacccgagagggctggggtgaggcttttccctcacccaaaccctctccgtgaggagaggggctttttgccggatgcggcgtaaacgccttatccggcctacgtgtttggcactgacctgtaggcctgataagacgcgtcagcgtcgcatcaggcattgtgcaccgactgccggatgcggcgtaaacgccttatccggcctacgtgtttggcactgacctgtaggcctgataagacgcgtcagcgtcgcatcaggcattgtgtaccgactgccggatgcggcgtaaacaccttatccgaccgacaaaacaaattgtgctttatgttgtaggcctgataagcgaagcgcatcaggcaattagccccaccttcttcatgcggagagggtgggaatggattacttacgacctgccagcagttccagcacttcatccacgctggtggtgtgtgccagacgctcgatgacagactcatcatccagtgcgttggtcaggctggtgatcacctgaatgtgctcgttgttacgggcagcaataccaatcaccagacgggcaatgtcatcttcttcttcaccgaagcgcacgccttccgggtactggcagaacacgacgcccgttttcagtacgcgatctttcgcttcaaccgtaccgtgtggcaccgcgatagactcacccagataagtcggggtcagtttttcacgatccaacatcgcctgaacgtattccggctcaacgtaaccgcctttcaccagctgctcgccagcaaaacgaatcgcttcttctttggtggccgctttgcgaccgaggaagatgttctccgcgcccagtttgaacagattagcactggaatcgtcaaagctgtctttcagactgtctttcactttcacttcgttttcagtatggcgctgggcagcaaccagacgttcggtcaggctggtgtacaggccgctgtcgaggaagttggtcagcgaaatatgctgtgcctgcggaacctggcgcatagcgcgttcggtcaggtcacggtgagtgatgaccaggtccacatctggcggcaggttgttgatcgcgctgttagtgaccgaaatctgcgacagacctgcatcctgaattttcttacgcagcacgcctgcgcccatcgcactggaacccataccggcatcacaggcaacgatgattttacgtacgtggctcaggtcgttagtcacatcgcccgcagacagcggagatgcgcctttagactcagctttcatttcctgaacgcgacgtgcagcagcttcaatatcatcttcttctttcactttgctggttttcagcagaatggcagagacaacgaaggagactgccatcgccgcacacacacccgcgatgttagcgaagtaagcaccttttggcgtcatcgccagtacagcaaggatagaacccggagatgccggagaaaccagaccaccgcccaggatagtcagcgtaaacacgccagtcataccaccgaggataacggccagaatcagacgcggattcatcagcacatacgggaagtagatttcgtggataccgcccaggaagtggatgattgccgcaccgcccgcagactgtttagcgctaccacgaccaaagaacatgtacgccagcagcacgcccatacccggacctgggttagcttcaatcaggaagaagatggatttacccagttcatgggactgctgaatacccagcggcgagaagataccgtggttaatggcgttgttgaggaacaggattttcgccggttcaacaaagatagacgccagcggcagcatgtcatggacaaccatgaagttaacgcccgccgccagcattttagacagggcttcaacaaccgggccaatgccgagaaatgccagaatagcgaggatcatcccgatgatgcctgcggagaagttattcaccagcatttcaaaaccggatttgatcttaccgtctacccagcggtcgaagtgcttaatgcaccagccgcccagcggacctgcaatcatagagccgaggaacatcggcatgtctgcgccgacgataacgcccatggtggtgatggcaccgactacgccgccacgttcgccgcctaccagcttaccaccggtataaccgatcagcagcggcaggagataagtgatcatcggcccgaccagcttcgccagcgtttcgttcggtaaccaccctgttggaataaataacgcggtgatgataccccacgcgataaacgcgccgatatttggcatcaccatgttgctgaggaaacgaccaaagctttgcactttgatcttaatatcggatgacataaaaacaccccttcttatgtttgctgtcgcgcaggctggaagcccgaggttttttgttaatgtggcggcagaggtagccggaccttgtagatactgcgaaatctggcactgaatcggttaactgtccagtcggcggccttttgtgtgatatcagtcacataaatgtagggggtagagaggtaattgacgtgatgctcatcacaaaatgcttgtgtaaaaaagcaacaaggcggcgattttcgctaaaaatggcatttaaatgtgagttatgtcacatttttattttgatggtttgttgaatctttgtgatctgaatcacaagatattttcttacggcgttcacctgatgtgatctacagcatgttatgccttcgtcatgaaatcgttatgtaactaagcaactcatcacctcttaaaattattctttggtgttatggcgagaatcgcgaacccggattattgtcaaaatatcagcctgactcccttctggctgccagccaaaaaacaacactgataaacgtgaatccgaggcagatatgtttctaaactatttcgcgttgggagtgctgatcttcgtctttctggtgattttttatggaatcatcgcgatacatgacatcccttatctgattgccaaaaagcgcaaccatccccatgccgacgctattcatacggcgggctgggtgagcctgtttactctgcatgttatctggccgttcctgtggatctgggcgacgctctatcaaccggagcgcggctggggcatgcagtcacatgttgcgccgcaaggcgacgtgccagacccggaaatcgccgcactttctgaccggatttcccggctggagcaccaactcgccgccgagaaaaagactgactattccacgtttccggagatctaattatggatctattgattgttttaacttacgtggcgctggcgtgggcggtctttaaaatcttccgcattccggtgaatcagtggacgctggcgacggcggcgctgggaggcgtgtttctggtgagtggtttgattttgttgatgaactacaaccacccttacacttttaccgcgcaaaaggcagtgatagcgatccccatcacgccacaggtgacgggaattgttactgaagtcaccgacaaaaataatcagcttattcagaagggcgaggtgctttttaagctcgacccggttcgttaccaggcgcgagttgacaggcttcaggctgacctgatgacggcgacgcataatataaagacgctgcgcgcgcagctcactgaagcgcaggccaacaccacccaggtttcagcggagcgcgaccgtctgtttaaaaattatcaacgttacctgaaaggcagccaggcggcggtgaatccgttctcggaacgtgacatcgacgatgcgcggcaaaatttcctcgcgcaggatgcgctggtgaaaggctcggtggcggagcaggcgcagatccagagccagctcgacagtatggttaacggcgagcaatcgcagattgtgagcttaagagcgcaacttactgaagcaaaatataaccttgagcagaccgtcattcgcgcaccgagcaatggctacgtcactcaggtactgatccgcccaggtacatacgcagctgccttgccgctacgtccggtgatggttttcatccccgagcaaaaacggcaaattgtcgcccaatttcggcagaactcgctgttacgtctgaaacccggcgatgatgcggaagtggtgtttaacgcgctacctgggcaggtgtttcacggcaaactgaccagtattttacctgtcgtgccaggcggttcttatcaggcgcagggggtattgcaatcattaacggtcgtgcccggcacggacggtgtgctgggaaccattgaactggaccctgacgctgatatcgatgccttacccgacggcatctacgcccaggtggcagtttactccgaccatttcagccatgtttcggtgatgcggaaagtgctgctaagaatgaccagttggatgcattatctttatttggatcattgagacttgtatcacctgtgttttgcgcgagcctgagccatactgatatttttcctcgcacaaaggactcggcatgaaactcgtcggtagctacaccagcccgtttgtacgcaaactttctattctgttgttagaaaagggcataacgttcgaatttattaatgaactgccctataacgcggataacggcgtggcgcaatttaacccgttaggaaaagtaccggtactggtgaccgaagagggcgaatgctggtttgattcaccgatcatcgctgaatatattgaattaatgaatgttgctccggcgatgttgccgcgcgatccgctggagtcgttgcgggtgcgcaaaattgaggcactggcggatggcattatggatgccgggctggtatcggtgcgtgaacaggcgcgtccggcggcgcagcagtctgaagatgaattgttacgtcagcgtgagaaaatcaaccgcagtctggatgtgctggaaggatatctggtcgatggcacgctcaaaaccgatacggtcaatctggcgactatcgccattgcctgtgccgtcggatatctcaatttccgccgcgttgcgccaggctggtgtgtcgaccgcccacacttagtcaaactggtcgaaaacctgtttagccgcgaaagttttgctcgcaccgaaccgccaaaggcttgatgcgcgatatgtcctcctgacccatctcacgttacaatccgtggttatgttaaacgcccttctccgtgtgagagggccttgatcagccaggtttcctatgacaaccgaaacgcgttccctctatagtcaacttccggctattgatcgcttattgcgcgatagctccttcctttctttgcgtgatacttatggtcacacccgcgtggtggaattgctgcgtcagatgcttgacgaagcgcgagaagtgattcgagacagccagacgctgcccgcatggtgtgaaaactgggcgcaagaagtcgatgcccggttgacgaaagaggcgcagagcgcgctgcgtccggtgatcaacctgacgggaaccgtgctgcataccaatcttgggcgagctttacaggcagaagccgcggtggaagccgttgcgcaggctatgcgttcgccagtgaccctcgagtacgatctggacgacgccggacgcggacatcgcgatcgggcgctggcgcagctgctgtgccgcattacgggagcggaagatgcctgtatcgttaataacaatgcggcggcggtgttattgatgttggcggccactgccagcgggaaagaggtggtggtatctcgcggcgaactggtggagattggcggcgcgtttcgtattcctgatgtcatgcgtcaggcaggctgcaccctacacgaagtgggaaccaccaaccgcacgcacgctaatgattatcgtcaggcggtgaatgaaaataccgcgctgttgatgaaagtacataccagtaactacagcattcaggggttcaccaaagcgatagatgaagcggaactggtggcgctcggcaaagaactggatgttccagtggtgactgatttaggcagtggctcgctggtcgatcttagccagtacggtttgccgaaagagccaatgccgcaggagttgattgcggcgggcgtcagtctggtgagcttctccggcgacaagctgttaggcgggccgcaggcaggaattattgttggtaaaaaagaaatgatcgcccgcctgcaaagccacccgctgaagcgtgcattacgcgcggataaaatgaccctcgcggcgctggaagccacgttgcgtctttatttacaccctgaagctctgagtgaaaaattaccgaccctgcgcctgcttacccgcagcgcagaggtcattcaaatccaggcacaacgtttacaggctccccttgccgcacattacggcgcggagtttgcggtacaggttatgccatgtctttcgcagatcggcagtggttcgctgccggttgatcgcctgccgagcgcggcattaacgtttaccccccatgatggacgcggtagccaccttgagtcattagccgcccgctggcgtgaattgccagtgccggtgattggtcgtatttatgacggacgattgtggctggatttacgctgccttgaagatgagcaacggtttttggagatgttgttgaaatgattattgcgactgccggacacgttgaccacggcaaaacaaccttgttgcaggcgattacgggcgtaaatgccgaccgtctgccggaagaaaaaaagcgcggcatgaccatcgatctcggctatgcctactggccgcagccggatggtcgcgtgcctggttttatcgacgtgcccggtcatgaaaagtttctttccaacatgctggcgggcgttggtggtatcgatcacgcgctgttggtggtggcgtgcgatgacggtgtgatggcacagacccgtgagcatctggcgattttgcagctgaccggtaacccgatgctgacagtggcgctgaccaaagccgatcgcgtggacgaagcgcgtgttgatgaggttgaacgccaggtaaaggagatgctgcgggaatacggttttgctgaggcaaaactgtttatcaccgcagcaaccgaaggtcggggaattgatgccctgcgcgagcatctgcttcagttaccagaacgtgaacacgccagccaacatagtttccgcctcgcgatcgaccgcgcatttaccgtaaaaggtgccgggctggtcgtcaccggtacggcgttaagcggggaagtgaaagtaggcgattcactctggctgactggtgtaaataaaccgatgcgcgtgcgtgcgctgcatgcgcaaaatcagccaacagaaactgcccatgccgggcagcgtatcgcgcttaacatcgcgggtgatgcggaaaaagagcagattaaccgtggcgactggctgcttgccgatgtgccgccggagccgttcacacgggtgattgtcgagcttcaaacccatacaccgctgacccagtggcagccgctgcatattcaccacgccgccagccacgttacgggacgcgtttcgctgctggaagataaccttgccgagctggtgttcgacacgccgctgtggctggcggataacgatcgcttagtgctgcgcgatatctcggcccgcaacacgctggcgggggcgcgtgtggtgatgcttaacccgccgcgtcgcggtaagcgtaagccggaatatctgcaatggctggcgtctcttgcacgggcgcagagcgatgccgatgcgttatctgttcatctggaacgcggcgcggttaaccttgcggatttcgcctgggcacggcagctcaacggcgaagggatgcgcgaactgctgcaacagcctggctatattcaggctggttacagcttgttgaatgcgccagttgccgcccgctggcagcggaaaattctcgatacattagcgacttatcatgagcaacatcgcgatgaacctggtcctgggcgcgaacgtttgcgacgtatggcgttgccaatggaagatgaagcgctggtactgttgctgattgaaaagatgcgcgaaagcggcgacatccacagccatcacggctggctgcatctgccggatcataaagcgggcttcagtgcagagcagcaggccatctggcaaaaagcagagccgctgtttggtgacgagccatggtgggtgcgtgacctggcaaaagagacgggaaccgacgagcaggcaatgcgcctgacgctacgccaggcggcccagcaggggataattacggcgatcgttaaagatcgttattaccgtaacgatcggattgtcgaatttgccaatatgatccgcgatctcgatcaggaatgtggttcaacctgcgcggcggatttccgcgatcgtttaggtgttggtcgaaaactggcaattcaaattctggaatattttgaccgcattggttttacgcgtcgtcggggaaatgatcatttattgcgcgacgcattattatttccggaaaaataaggaaatgattaattcataataaatatgaattgatacaaaatttcctattaatgttaagaaggcacgttatttgatgaatgtaacgtgctttttattaaaaatattttaataaacggtaatgttgatcatattttcaaatgaaaatcctcagtaagctgcccgcccttttttacactttcaggagtgtgttatggcagcttcaaccttttttattccttccgtgaatgttattggtgctgattcattgaatgatgcaatgaatatgatggcagattatggatttacccgtaccttaattgtcaccgacaatatgttaacgaaattgggtatggcgggtgatgtgcaaaaagcactggaagaacgcaatatttttagcgttatttatgatggcacccaacctaaccccaccacggaaaacgtcgccgcaggtttgaaattacttaaagaaaataattgcgatagcgtgatttccttaggcggtggttctccacacgactgcgcaaaaggtattgcgctggttgcagccaacggcggtgacatccgcgattatgaaggcgttgaccgctctgcaaaaccgcagctgccgatgatcgccatcaacaccacggcgggtacggcctctgaaatgacccgtttctgcatcatcactgacgaagcgcgtcacatcaaaatggcgattgttgataaacatgtcactccgttgctttctgtcaatgactcatctctgatggtcggtatgccgaagtcactgaccgccgcaacgggtatggatgccttaacgcacgctatcgaagcgtatgtttctattgccgccacgccgatcactgacgcttgcgcactgaaagccgtgaccatgattgccgaaaacctgccgttagccgttgaagatggcagcaatgctaaagcgcgtgaagcaatggcttatgcccagttcctcgccggtatggcgttcaataatgcttctctgggttatgttcatgcgatggcgcaccagctgggcggtttctacaacctgccacacggtgtatgtaacgccgttttgctgccgcatgttcaggtattcaacagcaaagtcgccgctgcacgtctgcgtgattgtgccgctgcaatgggcgtgaacgtgacaggtaaaaacgacgcggaaggtgctgaagcctgcattaacgccatccgtgaactggcgaagaaagtggatatcccggcaggcctacgcgacctgaacgtgaaagaagaagatttcgcggttctggcgactaatgccctgaaagatgcctgcggctttactaacccgatccaggcaactcacgaagaaattgtggcgatttatcgcgcagcgatgtaattcccttcttcctgcggctggcgtgttgccagccgttttttatcaactatctctgtaatccttgcccgtaaattcgtgatagccgtcgtaaagctgttaccgactggcgaagatttcgccagtcacgtctacccttgttatacctcacaccgcaaggagacgatcatgaccaataatcccccttcagcacagattaagcccggcgagtatggtttccccctcaaattaaaagcccgctacgacaactttatcggtggcgaatgggtagcgcctgccgatggcgagtattaccagaacctgacgccggtgaccgggcagctactgtgcgaagtggcgtcttcgggcaaacgagacatcgatctggcgctggatgctgcgcataaagtgaaagataaatgggcgcacacctcggtgcaggatcgcgcggcgattctgtttaagattgccgatcgaatggaacaaaaccttgaacttttagcgacggcagaaacctgggataacggcaaacccattcgcgaaaccagtgctgccgacgtgccgctggcgattgatcattttcgctatttcgcctcgtgtattcgggcgcaggaaggtgggatcagtgaagtggatagcgaaaccgtggcctatcatttccatgaaccgttaggcgtggtggggcagattatcccgtggaacttcccgctgctgatggcgagctggaaaatggctcccgcgctggcggctggcaactgtgtggtgctgaaacccgcacgtcttactccgctttctgtactgctgctaatggaaatcgtcggtgatttactgccgccaggggtggtgaacgtggtcaacggcgcaggtggggaaattggcgaatatctggcgacctcgaaacgcatcgccaaagtggcgtttaccggctcaacggaagtgggccaacaaattatgcaatacgccacgcaaaacattattccggtgacgctggagctgggcggcaaatcgccaaatatcttctttgctgatgtgatggatgaagaagatgcctttttcgataaagcgctggaaggctttgcactgtttgcctttaaccagggcgaagtttgcacctgtccaagccgtgctttagtgcaggagtctatctacgaacgctttatggaacgcgctatccgccgtgtcgaaagcattcgcagcggtaacccgctcgacagcgtgacgcaaatgggcgcgcaggtttctcacgggcaactggaaaccatcctcaactacattgatatcggtaaaaaagagggcgctgatgtgctcaccggcgggcgacgtaagctgctggaaggcgaactgaaagacggctactacctcgaaccgacgattctgtttggtcagaacaatatgcgcgtgttccaggaggagatttttggcccggtgctggcggtaaccaccttcaaaacgatggaagaagcgctggagctggcgaacgatacgcaatatggtctgggcgcgggcgtctggagccgcaacggtaatctggcctataagatggggcgcggcattcaggcagggcgcgtgtggaccaactgttatcacgcttacccggcacatgcggcgtttggcggctacaaacaatcaggcattggccgtgaaacccacaaaatgatgcttgagcattaccagcaaaccaagtgcctgctggtgagctactcggataaaccgttggggctgttctgatgtgaaaggctgcccggcgtgtattgccgggcactatcaggtatggctactgcccgtaataggcattggccccatgcttacgcaggtagtgcttatccagcagttcgttttgcatcgcagggagctgtggcgcaagctggcgcgagaacagacccatataggcgcactcttccagtaccacggcgttatgcaccgcatcggcggcattttttccccaggcgaacgggccgtgagaatgcaccagtaccgccgggatttttgccgggttcaacccacgctcttcgaaggttttaatgatcacttcgccggtctggtattcatactcgccgttgatctcttctgcggtcatcaggcgcgtgcaggggatggctccgtaaaaataatcggcgtgagtagtgccccaggcggggagatcaagtccggcctgcgaccagatggtggcgtggcgcgagtgggtatgcactatgccgccaatctccgcaaagcgacggtaaagcgccagatgcgttggcgtgtcggaagagggctttttgctgccttccaccaccttgccgctggctatctcaaccaccaccatatcgtcggcggtcattacctcatactcaacgccggaaggcttaatcaccatccattgccgcgtttcgtctatcgcgctgacattgccccaggtgaacgtcaccagatgatgaacgggaagcgccaggtttgccgccagcacgtcggctttcagttgctctaacatataaatccggcctcctgcatacgcgcttcaatccagcgccgcgcctgaataatctccagcaccggttctttggctttttcggtccacatttcaatcagaaatgatccgcgatagttcagctcatgcagcgttttgaagatgccaacaaaatcgacacagccttcgccaaacggcacatcgcggaactgtccggggctatgttcggtaacgggttgagtgtctttcaggtggatggcggcgatacggtcgatgcccagtttcagttcggcgggaacatcattgccccaggcgctgagattgcctacgtccgggtaaacggtgaaccacggtgacgcaagcatttcgtcccactttttccatttgctgatagagttcataaacgcggtgtccataatctccaccgccagcatgacttgtgatgccgctgcctgttcaaccgcccacgccagcccttcagcaaaccgttgctgggtgccttcgtcatgatcctcgtaatagacgtcgtaacctgccagttgaatagtacgaatgccgagatcgcgcgccaggcgaatcgctttactcataatctcccgcgcccgctggcgcacggcgtcgtcccggctaccaaaaggaaaacgacgatgtgcggacaggcacattgacggaatagcaacacccgtttcgatcatcgcagtgaccagcgaagcacgttgtgcggcgctccagtcaagacgtgacaaccgttcgtcggtttcatccaccgacatttcgacaaaatcaaaaccacagctttttgccagtaccagccgctccggccaggagagatctttcgccagcgctttttcataaatgcctaacggatgattacgcacgcttgcctccccagatggagtcgatttgcgcatggaaatcgccagccacttgcgccggatttgctgcgcctgccagcgcccgtccggcaataaacgctttcacgcggatctctttaaacagcggcaggtcagcaggggtaatcccgccagtaatggaaagctcaaggccgatatcggaaagcgctttcatgcgtgccagatcggcctcgccccactgttgcccgctggcctgcgcgtcacgaccacgatgataaatcgcctgtcgtacaccaatacgatgccagtcgcgggcgtcgtccagcgtccagttaccgaatagctcgatctgaatttcaccaccgcagttctgtgccatcgcgtggcctttttccaccgtggcgagcggcgcggcgcagatgatggtcatccagttagcgcctgcgccaaatgcctgttgcgcgagcgtttcacccgcgtcggcgaccttccagtcggcaacgatgattttgtcagggcactgttcgcgcaaggctttcactgcgccaagcccttcgtttaaacagagaatggtgcctgcttcgacaatatcgacgctgtcttttaaccgcgtcacgtcgcgctgcgcggcttcaagtgatgagtggtcgagggccagttgcagaagtggtcgactcataatgtgtgctccttgatgcgggtgtgataaccctgaagtgcggcaatgagatgttgatagcgttggtatttttgttggtaaagctgatgcgcggccatatccggctgcagggtgcgtaccgggtgctgtaagtcacgttgggcttcgctgaaatcgcgataaaccccggtaccgacgcgggcggcaagtgccgcaccaaagcagccggtttcttccacctgcggcagctcgatacgcagaccgctgacgtccgccagcatttgcatccagacatcggagtgcgccgggccgccagtgacgcgcagggtgtgcacatcagtaaaacgttcgcgcatccggttgagatgggtcatatggctgaacaccaccccttcatagatagcctgtaagaggtgtgcacgggtgtgaatggcctgcatcccgtagaaaccgctggtcatttcgagtccggcgttgctgccgtacaggaacggcaggaaaaagagatcgccaccggctttcggcaaactggctacggcctgattaatctcagcaaatgagatttctccccactgtgcggtaaaccattcgagattgccggaagaggtggggctggcttcgtgaacgataaattgaccatcgttaacgtagcgaccatagacatacggatgcgcttcaccgtcacgtaaaccgtgggttatgccgctggtcaccgcccaggtccccatcaccgcattgagggtgaattcgtcttcgagcccggcgcagagtgcggtggaaaccacatcaaacaggccgccgacaacgggggtacccgctttcagaccggtcagtacggctgtctgagcggtgatttccccgcagatttcggcagatccgacaacaggcggcagggcgtgattgatttcagcaatccccagccagtcggtaaggcacgggtcatattccccgcgactcatgttgtagagattggactcagaaatattgctctcttcgcaacctttgacgccggttaaacaccagcgcaggtagtcgtgcgtcatcatcacgcagccaatttgcgcgtagcgttctggttcgtgctctttcagccagcgtaacagcgacaccggatgcccggtccataaggtttgtcgggtcagcggatagagtttttccgggatgccatctttctgccagcgacgaacgatttccatcgcccggcgatccgaggacaaaatggcgttaccgagcggtttgtcgtttttatcaagtagaaataagccctttccctgcgcggagatgccgataccgacaatttgttccccgctgacgccggaatgggtaagcagggcgcgaatgacagcagtgcaacattgccacagttctgccatgtcgcgctctgcccagcctggctgtggacttgatgcgcacagcggcaggcgctgcacgcccgcctcccggccttctcggtcatacagcccggctttcagccagctaccgccacaatctaaccccagccagtattgcgtcatggtttattgcacctcatccacggctttcagcagatcagcaccctgcggaacatctttaacaaacatgtcacggacctgggtacccagcgcatcgctaaaggctttgcggtcgagatcggtgatgacttccacgcccgcttctttcataccgtcgatgattttttgctgatcttcggcgaccagtttgcgctgatagctacccgcttcctgtgcagatgagatcagtgcttgctggaactccggggttaagccatcaaacttcgctttgttgatcaccaccagaagcggcgaataggcgtgatgggtcagagaaaggtacttctgcacttcataaaattttgctgaccagacgacgttgatcgggtgttcctgagcgtcgatagtgcgggtttccagcccggtatagacttcggcaaacggcatcgggatcgggttagcgccaaaaactttaaatgcggcgatattcatcgggctgttgttggtgcggattttcaaccctttcaggtcggcaggcgttttgaccggtgcacgcgagttggtgacatcgcgccagccgttttcccagtaagccagcactttcagccccttaccttcaagggagactttcaggtcatcaccgactttgccgtcgagcgttttatgcgcgtgagcggtatcgcggaacaggaacgggacatcgagcaggttgatgacgggcgagagtcccgtaaagttgttagagccagacatctccatatcaatagtgccgccacgcacgccgctgatcatcgcctgcgcattaccaagggtgctatccgggaacagttttaatttcagttcgcctttggttttttcctgcagtaattcattaaattttttcgccgcaatatgttgtgaatcggtttgtgaggtttcataaccgaaacgtaatgattgtgccgccagagaagatgtgctgaacgtcgccactccggcaattaataaagcgtaggttacagaacgtaatttcattatgatttccttttaactcatccatttaagaggagcggtaatgagctccggtataaaaataaataatgctaacaacatgaataaaaccatgacgtaaggcgcaacgccttttaccgcatcgtcaaatttaagtttcgccacgccgcataccacgttaagaacattaccgactggaggcgtaatcagtgatattgaacagttgataataaacatgatgccgaaatagaccggatctattcccgcttctttcactaatggcattaatactggtgtaagaattaatacggtaggcgttaagtccatgaccgtactgatcaccataatagcgagcataatgacgatgaataataagcgaggcgaatcaaccaacggttgtaatagctccgataccatcatgggtaattcggcgatcgtaataagccatgcagataccgcagcagaggccaccaggaacatcaccacggatgtggtttttgccgcgttaatcagcacatgataaagcgtggagaaggtcatctcgcgatagaccaccaccgagacgaacagagcgtagaaggcggcaaccgcgcctgcttcggtcggtgtaaataaccccgaacggaaaccgccaataataattatcggtaaaaagagcgcccaaataccggaaactaaggattgccagacttctcgcagtgaggctttcggctgacaaggtaaattcagtcgttttgcctgccaccaccaggtaaccatcagcgtgacgcccatcatgatgcccggtgcgatgcccgccataaacagtttgctgatggagagtccgctggagacgccgaagataatgagtggtatggaaggcgggataatggccgcaataatccccccggaaccgataagcccggcggcgcggtttaccggatagttggcctggcgcatcatcggcaccagcagcgccgcgacagctgcggtatcagcaaccgcagaaccggacaggcttgccatgatcatcgctgccagcacgcccacgtaacccagaccgcctggcctgtggcctaccagtttcattggcaagtcgacgatacgttgcgacaggccgcccgcgttcatgatctcacccgccagtacaaagaaggggatggctaacagggagaagctgtctgcgccatttaccaacgtttgtgccagaatttgcacatcaaagatatccatccagaacatcaatgaaatgccgcacagtaataatgcccaggcgatgggaacgccaattgcgatagcccctaacaaactgacaataaatataaggattgtcatcgtcaggctccttgttggtttcggctgggggtatttgtgaactgccggtataagtgacgcaattccagcaatgcgataatcagactggtggggatagcggcggcgtacattaagccaacggggacgccaagaatgggcgataagttgctccagtcttgcgctgttttttctatagcgccccaggccagccccagacacagcaataaaatgagcgtatgggttagcagcgaaacacgttgttgattagccggtgagagtttttcgactaaaaaagtaacctgcacatggctgttgtccatataagcaacgattgcgccaataaaggttaaccagacaaataaaagtcgggataattcatcaatcgataatatacttgtgtggaatccatatcgaagaatgatattaataaaaataatacaagacagtattgcgatgatgatcgcaagaatgccttcgagtatccgtttcataacgagtccttctggttatgcaatattttttatgcgctaatgttgttaatattcgtaataattatcagaaaacggctaattagatattcaaagtgatatataagcggaactatttaacgagattcattcagagagtgaatgccgttacgtaatatttcgatgcgatggtgcacatcagccgtcgcatttatttccagtagcttgatgccagcaaaatgcaatgttgacgattctgctacattaaataactcgcgaacatgatctgtggtcatcaggctttctgcgcagaatggtgcaaacggtgcgtgtaaatcctgccattcgccgtatgccccgtttagcgtcgtaccagagaacattaacgcgccgagttttccggcttgtttcgccatttgggtgtgggtcagcggcagcgttgtattgcgcccttcaatggcagagcgcgcccagttgatacagatgctgatgtcataatcggtaataacttccagcacattttctaaaggcaaaaagccttttcggggggaagaagatgtcatggcgtcgcagtgttccagcaccagcttgcacggccagtcccaactggcgatttctttcaatgagcgggcaaaagcgtccgtcgcttgcataacattaggattcgttgctaacggtgcagcctggagctccagtgcgagcactttattagcctgcaatgagttgattttattgaacaggtggcgatagtacgccacgcaggcctggcgctgttcttcatcactggaggcgagaccaaacccgctgttttcgctgcggcgacgcatggtttccatcactgcggtgacgacaaatttccagctctctggcgtatgacggagtaaccattgatcgcccagcgggtgaaaattttccaggcaaggttgttccagccccaaaatgtctggagtctcagataattgtcgccagaaatccttctcttcctcttcacttctttggtgaaaagaaggtgcacagggatacgcgccgataatataaccggcattattcgttttcattatgtgctccagtaatcattttttataaagcagcgagggccactttaaccacgatcttgcgtattgccgtagtggcatttttattacatgccgggcgatgaacatcctgcgggaagaaaatagcgtagctgcccggaatcatttctataaatgattcatgttcactatcgtgataaaaaataatatcgcgctgctctaatagtgattcgctgactttattatttcccgtatcaatagcaatgccgattttctcttcaccccacgccagaaactgaatatcgatatatcgacgatgcacttccggacggttttctaccgcctcgcgtgtggttaaatcgataatttgcgcataaatattcttgccgtcgatttcgacaacgcccggttccagggcgttgaagtcgatggtgcgcagaaaatcgagcgccttttcaatggcggcgggcaaacggcacggattgggctgcgcgatatgtccaaaaatcatggcttatctccttataacgcctggatttttgcccacacgctgtcatcaacggtaataccgttacggcggttttctgccagcagggtagtaaattcgtggccgggtaaacgaatagcctggttttcgtcagcacgctcggcactggtaacgtaatccataatgcgttgcagtttggcatcgcgggtgggaccgtcgataagcttgtccacttcaatggcaataaaaatttgtgaaatgccgtattcgtcgctgttgtcctcggtgacttcggcaaccgatgcgccgtcagaaaggagggtagcgatcatatccagcacaagcgacatgcccgaacctttccagtagcccatcggcaaaatgcggcgatttttctcgataacgccaggttctttggtcaaattgccctcatcatcaaagccaccatctaccgggagctgacgaccagccaggcgattaacttctaacatgccgtaagagaacatcgacatcgacatatcgaccatggtgatcggcgtggaaggaatggcgacgatcagcgggttggtgccgatgcgacactcttttgcgccccacggtggcattacggcgatggagttggtccagcaaatgccaatatagcctttttccgccgcctgccagccgtagctgccgccgcgcatccagtggttggcattacgtagtgccaccagaccaataccgtgatcggcagccagttcaatggcgcgatccatcatctttttcgctgtcaggttaccgatcgaacgctgggcgtcccactgttcaattgcgccgaggctggttatacgtttgggttgggcatcaggaatgatatcgccgttttccagttgttgaatgaaacgagggaaacgattaacgccgtgagaataaacgcctgattcggtggtgcgggcgaacatctctgcacaggcgtcagccgtttcgctgtcaacgccgcgtgaaattaagacccgattaaaggctgcttttaactgctcaaatgtcactttcatcccaggcttccttgtttttttgatcgcttttttggcttaaaatttcaatatacgaaacttgatttcaaatatatcgatcactttttaacaaagcaatctgattgatgaatttcaaaaaacttaaaaatcaagtggttataaattatctgtcgagatcgtgaactacggcacactttgcgctaccatcaggacgcgacaaaatggggaaagaagtgatgggaaaaaaagagaacgagatggcgcaggaaaaagagcgcccagccggaagccagagtctgtttcgtgggttgatgctgattgagattttgagcaactatccaaacggttgtccgttggcgcatctttcggagctggctggtttaaataagagtaccgtccatcgcttattgcagggattacagtcctgcggctatgtgaccaccgcgcccgccgcagggagttatcgcctgaccaccaaatttattgccgtcgggcagaaggcgctatcttcgctgaatatcattcatatcgccgctccgcatcttgaggctctgaacatcgccactggtgaaactattaacttctccagccgcgaagacgatcacgctattttgatttataagctggaacccacaaccgggatgctgcgaacccgtgcctatataggccagcatatgccgctctactgttccgcaatgggcaagatctacatggcgtttggtcacccggactacgtgaagtcatactgggaaagccatcagcatgagatccagccgttaacccgcaataccattaccgagctgcccgcgatgttcgacgaactggcgcacattcgtgaaagtggagcggcgatggacagagaagaaaacgaactcggcgtctcctgtattgctgttccggtgtttgatattcatgggcgggtgccgtacgccgtgtcgatttcgctttcgacatcacgtctgaaacaggtgggagagaaaaatctcctgaaaccacttcgtgaaaccgcgcaggctatttctaatgaactgggatttactgtcagggacgaccagggcgcgattacataaccctttggacaagtgccaaaactttaacatttccttcgttggatcaaagcagtagggacgcgctctctggcactctgctgttttagtgcaaaggagtgatcatgaaccggtttattattgcggatgcgacgaaatgtatcggttgccgtacctgtgaagtggcttgcgcagtgtcgcatcaggagaatcaggattgcgctgcgttgtcaccagacgagtttatttcccgtattcgtgtcattaaagatcatacttacaccacggcagtagcctgtcatcagtgtgaagatgcaccgtgcgcaaatgtgtgccctgttgacgcgataagccgcgaacatgggcatattttcgttgaacaatcatgttgcattggctgtaaaagctgtatgctggcttgcccgtttggtgcgatggaggtcgtttcttcgcgcaaaaaggcgagggcgattaagtgcgatctgtgctggcatcgggcgacggggccggcctgtgttgaagcctgcccgacaaaggcgttgcagtgcatggatgtcgagaaagtgcagcggcatcggctacggcagcagcctgtttgaaacgtttttccggcgtttctcaacgcagggatagtgcgctttgtttatgccggatgcggctaaaacgccttatccggcctacaaattctaccaaattcaatatattgcagaaatcatgtaggcctgataagcgtagcgcatcaggcaatttttagtgactttcagcccaggctctttctatctcttctgccagaatcttcacacccgcctcaattttctccggctctggtacgtagttcatgcgcatacattgatgcgtatgcggccacggtttatccagtcccaggaagaagttgtgccccggcaccatcagcacgccgcgtgctttcaggcgctggtagagctgctcggtcgtaatgggcaaatccttaaaccatagccagaggaaaatggctccttccggtttatgaatcaggcagcgatcttccggtaaatagcggcgaatgatggcgatagtttcctgaacacgctggtagtaaaacggtttgatgactgtttcagacaggcgcagcagatcgttacgcttaatcatttcacacatcatcgccggaccaataccgccaggtgccaggctgataatgccgttcatattggtgatggcggtgatgattttttcattggcgatgataatgccgcagcgggagccaggtagccccagcttggaaagactcatgcacagcacgatattcggattccatagcgggcgcgcttcgctgaagatgatacccgggaacgggacgccataagcgttatcaatcaccagcggaatgccgtgttgattcgccagcgcgtcaagcttcagcaactcttcgtcagtaatcacattgcctgttggattcgtcggccgggagacgcaaatcatcccggtttcttcgccaatatgtagatgctcaaaatcaacgtggtatttaaactggccttccggcagcagttcaatattcggacgcgcagagacaaacagatcttcttccagtccggcgtcagcgtagccaatatattccggtgccagcgggaacagcacttttttgacccgaccatcggcacggcgtccggcaaacagattaaataagtagaaaaacgcgctctggctgccgtttgttagtgcaatattctgtggttcgatatcccagcccaacttctcgcgcagcattccggcaagcagtgtgagtagctccgttttcccctgtggaccgtcgtaattgcacagtgcatcagtcgctttgccactttccagcatgtcggtcagtagcgtctggaagtagtcctgcatttccgggatctgcgccggattaccgccgccgagcataatcgcgccaggcgtgcgtaaaccgtcgttcagatcttccatcagcagcgtaatgccggagtggcgggtaaatttgtcaccaaaaagggagaatgtcatagcgggatatctgtcgaactctgtagcaaggaaggtaacaataacgctacatttgctggggtgcaaatcggtctgttgaagagtgagcggtgctttatcctgcaatgctgattagggctgacattttatcctggttggcggcttcccgaggtactcacgaacgggaagccggaaaagtcactgttgccccgcccagatgaccagcactttatcgtcgccatgctcacgaacaaagccgtagccctgcttcagcgaaagtgtcgtttgtttgcccgcgccaattgcgggatggcgggcgcggaactggctgattttttgccagtgcgcgacgctggcggcagatttaccgctaacatcctgccagttcatatccgaacgcgtaccttgcagcggatcagaaccggtaggaccgaacggacgcgaggattcatcgccataaaaaatttgtaccgcgcctggcgctaataataataactctgctgctttgtcgcccccttcacggaacaggcgggtatcatgcgacgagaggtagctcaacacgttgaaatcctgcaatttctccgccatttgctgccaggtcgtatccatctgcgccagacaatcgactgctttcgccgcctgctcctgataatcgaaattgatcatcgcatcgaagtcgtggcgatagtaatcactttgcatcacgccgtggccccaggcttcaccggtcatccagaaaggtttgtcatctaatgctttgtcggggttagcttttttccattcgcgaagtgcagcgctggcttcggttttcagttgctgccaggcgggcaactcaacatgtttggcggtatcgacccgaaaaccatcaatcccatagtcgcggacccactgacttaaccagtgggttaagtaatcgcgaggggtaaagccgtcgatgtctttagcgtgggtatccgttttgtttttatagaacactggcagaccagaagcgctagttgattcggttttgatatccggcaaaaaggccagcgacatagtgagatcgtcgaatccaggattgtcgtaatcgccgatatccgttctgatccagttttttccccaccatttatcccagcctgttttgtcgctgaaattaatgtaatcgttaaagctatgccaggtttgcccggcggcaggtttccagtcgctccagcgttcacccagcgtttttttcagctcgtcaccagaaagatataacgcgccaaactgatactcctgcatatccgccagcgtggcatagccggtgtggttcatcacgacatcaaagagaatacgaataccgcgctgatgcgcgctatcaaccagcgtccgtagatcggcttcactgcccatattggcatcaagattcgtccagtcctgtgtgtaataaccatgataggcataatgcgggaaatcaccttttgtaccgccgccgacccagccgtgaatttgctcaaatggggcgcttatccataaagcattaacgcccaactgctggagataatccagtttgttggtcaggccgcgtaaatcgccgccgtgaaaagtgccaatttccgccataccgtctttatgacgtccgtaactctggtcattactgggatcgccgttttcgaaacgatctgtcagcacaaagtaaaccgtggcgttatgccagtcgaaaggggcggatgtgtcagtttctgcccgttccagcaggagtaaaccgttgctggtggcagcgggttgtaacgttatttgaccgttcttcactatcgcaatttgctggctgtaataatcccggacagcggctccctccgcaaaagtggcgctgacatccagtgtgagcggtaatccatcccatttcgggcattcacggaccaggcttgctaccggttcgacggtgttctggagggaaatcatcaatgttggcgtaccggagcgggtgtctagttgcagcgtatattcgccgtccctgaacaatcgccattgaggtggcgtgttgctacaaggttgcagggaaagcatctgattgagttttatcgcatccgcaggctgccagcactgttggtcaaaatttagcattagtggacgcgtacctttgggcaactgcgcgtggctgacaaatgttcccgtcccctgttcgctaaaggcagggaaccccggagaagtccagctggcggcaacggcgaagccaggaaggagtgtcagaaaacaggcggcgagtttcatggcggatgagtccttattgctgcgatttcagacagtttgccagcgataagccagacaaaactcatccctgagcggtaagtccacaggatgagaagcaagggtgagcgatcgcgcgcaaaaaacggctgaattttgcgataaaccccacattttctgcgatttagcgccaatctgaatcgttaactcgtgacatagtttcagatttggactattccttggggtgctcttgacagctatttttgatatgatttgagattcaactctcaaatttgtaaaaaatataaggtgttggaatgattaaatccgaccaggagacctgatgattttgactcccatacgacgatatggggcgatgattcttatgttactcactctggtgttttcgagtgaggtgttagcgaagacgcacacaacaacagcgagtcaaaagtcccacttaactaaagctagtaataaacaggtaagcagtaaacaagagtattctcgcaatagtgcaaagagtagttcacttcctgatttgcgaaaatacccttccggaacaccaaggaaaaaggcgtttctccggactgtaatgccttacattaccagccaaaatgcggccattactgcggaacgtaactggctgatttcaaaacagtatcagggccaatggtcacctgctgagcgtgcgcgtctgaaagacatcgccaaacgctacaaggtgaagtggtctggtaatacgcgaaaaatcccgtggaataccttgcttgaacgcgtagacattatccctaccagtatggtggcgacgatggctgcagcagaaagcggttggggaacgtcaaagctggcgcgcaacaacaacaacctgttcggcatgaaatgcatgaaaggacgttgtaccaatgcgccgggtaaagtgaaagggtactcacagtttagttctgtcaaagaatcggtgagcgcctatgtcactaacctcaatacgcacccggcttactcttcgttccgtaaatcgcgtgcacaactgcgtaaagcggatcaggaagtgactgccacagcgatgattcacaagctgaagggctactcgaccaaagggaagagttataacaactacctgttcgcaatgtaccaggataaccaacggttaatcgcggcgcatatgtaattgcatttcctcgagccttatccgacttgtcaggcggataaggcttttgctcgtatcaggtggttgtgctgagttacctgatgcgacgccgataattctcatcatcgctacaacatgacctcgctatttacatcgcgatactcttttggcgttgtgtcatatgcttttttaaaaacagagtagaaatattgcagcgatggataaccgcacatttgcgatatctcgttaattgacaaggtggttgaaatcagcagactgcgcgctttctccagcttctcggcatgaatcatggcatggatggtttcacccacctcttctttaaaacgcttctcaagattggagcgtgatatgcccaccgcatccagtacctgatccactttaatccctttacaggcgtgattacgaatgtaatgcatggcctgaataacggcgggatcggtcagcgagcggtaatccgttgaacgtcgttcaatcacgcggactggcgggaccaaaatccgctgtagcggcatttcttctttatctaataatcgatgcaacagttttgccgcctgatagcccatttgccgtgcgccctgagcgacagaagagagagcgacgcgcgaaagatagcgggtcagttcttcgttatcgatgccaatcacgcataatttttccggtacgggaatgtgtagatgttcacatacttgcagaatatgccgcgcccgggcgtcagtaacggcaataatcccggtttgcggtggcagcgtttgtagccagtctgccagccgattttgcgcgtgttgccagttctctggcgcggtttctaacccctgataaaccactccgcgatacttttcttcggcgacaagctgacgaaatgcatattcgcgttcagtggcccaacgtttaccgcttgattccggaagaccataaaaagcaaagcggttaacgcctttctcttttaaatgcaaaaatgcgctttcaaccagcgcatagttatcggtggcaatgtaatgaacgggtgggtaactttcggcaaggtgatacgagccaccaaccccaacaatggggacgtcgacatcagccagcgcttgctcgatttgtttgtcgtcgaagtcggcaatgacgccatctcctaaccagtccttgattttatcaatgcgggcgcggaaatcttcttcaatgaaaatatcccattccgattgtgacgcctgtaaatattcccctacgccttctactacctgccggtcataggctttattggcattgaacagtaatgtgatgcggtgacgtttagtaaacatggttcttttcctgctgaatcatgcaaaaactcaaaaccggtaatacgttaccggctttgagaaaatttttatcaaaatcaagaacggcgtttggttgcggagtccatccatactgccagcaacagaatcgcacctttaacgatatactgccagaaggtcggtacatccatcatactcatgccgttatccagtgaagccatgatgaatgcccccattaccgctccagccacgctcccgacgccgcctgccagactggtgccgccaatcacacatgctgcaattgcgtccagttcggcgatatttcccgcagaaggtgaaccagcgccgagtcgagaactgaggattaatccggcgatggctaccattaatccgttaatagcgaacacggcaagtttggtgcgttcaacgttaatcccggagagacgtgccgcttccagattgccgccgatggcataaatgcgtcgtccaaatgccgtccgcgttgccataaacattccgccgagtaacagcaacgtcagcagcagaacaggagtgggaacaccacggtaatcattcaacagccagattgcgcctaatacgatgatagcggttaaagcctggcgaccgactactgcggtagaggccggagactgcaaacccaaagcctgacggcgcattcttccgcgccattgccagccaacaaaagccattaagccaagcgcgccaatgatgaagccggtgctggcaggtagatagctttgcccaatttgtgacatcgcggcgctggtgggggaaacagtcgtgccgttggtgatgccaatgagtatgccacgaaatgccaacatgcccgcgagggtgacaataaatgaagggactttgcggtacgcgacccaccatccgttccaggctccgagaagcagtcccagaaccaacgtcacaatgatggtaagtggcaaaggccagcctagccagacgtcacaaatcgccgcgacgccacctaacagccccatcattgagccgacggaaaggtcgatttcagcagaaattatgacgaacaccattcctaccgcgaggatgccggtaattgcggtttggcgtaacaggttggagacgttacgggcgcttaagtaggcaccatcggtggtccaggtaaagaacagcatgattgcgatgatagctgcaatcatcacgaagacctgcaaattcagtgatttcagcccggaaaagccaccggatgtcggtacggctaatttcacttcagacggattgcttttcgacatgatgttcgctcctcaatgcggcttccatcacctgctcctgagtcaggttatgatttatcaggttggcttttagtttcccttcatgcatcaccagtacacgatcgctaaggccgagcacttcaggtaattcggaagagatgacaataacggcaataccctgctggacgagttggttaattaatttgtagatctcgtatttcgcgccaatatcgatacccctggtgggttcatcaagaatgagaatgcgcgggttaagtaacagacagcgagcgaggatcgctttttgttgattgccgccgctcaaacgtccaatagcaaggtcgggggacgacgttttaactttgagttgctggattgattccagaatacatttttgctctgccgcgtcatcaagctggctaatactaccggtaaattttttgagtgcggcgagggtaatatttttaccaaccgccattaccggaacgatgccgtcgcgctttctgtcttcgggtaccatcgcaatcccctgggcgatggcttgctgacagttacgaatatctacctgtttgccgtcaatataaattttcccttcccattgtccgggccacacaccaaacaggcactgaatagtctcggtacgtccggcaccaacgagtccggcgatacccagtatttcgccacgtttcagggaaaacgagacatcattaactcgtttaatatgacgattaaccggatgccatgccgtcagatgttcaatacgtaatatttcatctccggtggtatgtggttcattagggtaaagcgcggttaactcccgcccgaccatcatggtgataatatcgtcttcactcattccagcagcatcacgcgtgccaatgtgctgaccgtcgcgaataacgcaaatcgtatcggaaatcgctttgacttcgttgagtttgtgcgaaatataaatacaggcgataccgtgctgttgtagatcgcgaataatatccagtaaaaccgacgtttcctgctcagttaatgaggctgtcggctcatcgagaattaacaaacgcacctgtttattaagtgccttggcaatttcaaccagttgttgttgcccaagtcctaaatcgccaacgcgggtatcaggtgaaatggataaactgacctgtgcgagcagcttctgacagcgtagcgtcatcaggtcataatccataatgccattatgggttatttcgttacccaggaagatattttccagcacggtcagttctttcaccagcgccaattcctggtgaataatggcgatacctttgcgttcggtatcgcggatgtgactcgcctgaatctcttctcccgcaaaaataatttcgccttcgtaggaaccatggggataaataccacacagcactttcatcagcgttgatttacctgacccattttccccacagagtgagacgatttcgccagcattcaaccgcaagctgacgttatcaatcgccttcacactgccgaaggttttggtaatgttcttcatttcaagtagataaggcataacgactccacctaagccaattaattcacgcggcatggagagaaatcacgcccccgctccgcgccggggcgtaacgcttacagctcgctctctttgtggaatccgtctttaactatcgtatctttgatgttgtttttattcacatcgatcggtgtcagcaggcgggagggaacatctttcaggccattattcagtgtggtatccgcttttggctcctgaccattgcccaactcaacggcaatttctgcggcagtatttgccaacaatgtaataggtttatacaccgtcatagtttgcgtaccggcagcaatacgtttaatacctgcaagatccgcatcctggccggaaattgctactttccctgataaaccttgcgcgcttaatgcctgaattgcccctcctgcggtggcatcatttgaggcaactacagcatcaattttgttattattggcggttagcgcgttttccataattttcaatgcgttttccggtaaccagccatcaacccattggtcaccaacgactttaatttttccggaatcaacataaggttttaatactttcatttgcccggcgcggaacagcttggcgttgttatctaccggcgagccgcccatcaggaagtaattaccttgcggaacaatatcgaccagggcttttgcctgcagttcaccgactttttcgttatcgaaagaaatataaaaatcgatatccgcatcgttaatcatacggtcgtaagctaatactttaataccttcttgtttggcttctttgacaacgttacttaatacctgaccgttataaggaataatgacaagaacatcgacaccccggttaatcatgttttcaatctgcgacatttgtgtttcttcattgccatttgcagactgtacaaatactttcgcgccgagagattctgcttttttcacaaaaatatctcgatctttttgccagcgttcaagacggagatcatcaatcgccatacctattttgacttctttggcgtgtgccgcaacgttggtaagcagaagtgaggtgcaaagggtgagtagaatgttctttattttcatggtgtagggccttctgtagttagaggacagctttaataagtaacaatcaccgcgataaacgtaaccaatttttagcaactaaacaggggaaaacaattacagatttttatctttcgattacgatttttggtttatttcttgatttatgaccgagatcttacttttgttgcgcaattgtacttattgcatttttctcttcgaggaattacccagtttcatcatcccattttattttgcgagcgagcgcacacttgtgaattatctcaatagcagtgtgaaataacataattgagcaactgaaagggagtgcccaatattacgacatcatccatcacccgcggcattacctgattatggagttcaatatgcaagcctattttgaccagctcgatcgcgttcgttatgaaggctcaaaatcctcaaacccgttagcattccgtcactacaatcccgacgaactggtgttgggcaagcgtatggaagagcacttgcgttttgccgcctgctactggcacaccttctgctggaacggggcggatatgtttggtgtgggagcgtttaatcgtccgtggcagcagcctggtgaggcactggcgttggcgaagcgtaaagcagatgtcgcatttgagtttttccacaagttacatgtgccattttattgcttccacgatgtggatgtttcccctgagggcgcgtcgttaaaagagtacatcaataattttgcgcaaatggttgatgtcctggcaggcaagcaagaagagagcggcgtgaagctgctgtggggaactgctaactgctttacaaaccctcgctatggcgcgggtgcggcgacgaacccagatcctgaagtcttcagttgggcggcaacgcaagttgttacagcgatggaagcaacccataaattgggcggtgaaaactatgtcctgtggggtggtcgtgaaggttacgaaacgctgttaaataccgacttgcgccaggagcgtgaacagctgggccgctttatgcagatggtggttgagcataaacataaaatcggtttccagggcacgttgcttatcgaaccgaaaccgcaagaaccgaccaaacatcaatatgattacgatgctgcgacggtctatggcttcctgaaacagtttggtctggaaaaagagattaaactgaatattgaagctaaccacgcgacgctggcaggtcactctttccatcatgaaatagccaccgccattgcgcttggcctgttcggttctgtcgacgccaaccgtggcgatgcgcaactgggctgggacaccgaccagttcccgaacagtgtggaagagaatgcgctggtgatgtatgaaattctcaaagcaggcggtttcaccaccggtggtctgaacttcgatgccaaagtacgtcgtcaaagtactgataaatatgatctgttttacggtcatatcggcgcgatggatacgatggcgttggcgctgaaaattgcagcgcgcatgattgaagatggcgagctggataaacgcatcgcgcagcgttattccggctggaatagtgaattaggccagcaaatcctgaaaggccaaatgtcactggcagatttagccaaatatgctcaggaacataatttgtctccggtgcatcagagtggtcgccaggagcaactggaaaatctggtaaatcattatctgttcgacaaataacggctaactgtgcagtccgttggcccggttatcagtagcgataccgggcatttttttaaggaacgatcgatatgtatatcgggatagatcttggcacctcgggcgtaaaagttattttgctcaacgagcagggtgaggtggttgctgcgcaaacggaaaagctgaccgtttcgcgcccgcatccactctggtcggaacaagacccggaacagtggtggcaggcaactgatcgcgcaatgaaagctctgggcgttcagcattctctgcaagacgttaaagcattaggtattgccggacagatgcacggtgcaaccttactggatgctcagcaacgggtgttacgccctgccattttgtggaacgacgggcgctgtgcgcaagagtgcactttgctggaagcgcgagttccgcaatcgcgggtgattaccggcaacctgatgatgcccggatttactgcgcctaaattgctatgggttcagcggcatgagccggagatattccgtcaaatcgataaagtattattaccgaaagattacttgcgtctgcgtatgacgggggagtttgccagcgatatgtctgacgcagctggcactatgtggctggatgtcgcaaagcgtgactggagcgatctcatgctgcaggcttgccacttatctcgtgaccagatgcccgcattatacgaaggcagcgaaattactggtgctttgttacctgaagttgcgaaagcgtggggtatggcggcggtgccagttatcgcaggcggtggcgacaatgcagctggtgcggttggtgtgggaatggttgatgctaatcaggcaatgttatcgctggggacgtcgggggtctattttgctgtcagcgaagggttcttaagcaagccagaaagcgccgtacatagcttttgccatgcgttaccgcaacgttggcatttaatgtctgtaatgctgagtgcggcttcgtgtctggattgggccgcgaaattaaccggcctgagcaatgtccctgctttaatcaccgcagctcaacaggctgatgaaagtgccgagccagtttggtttctgccttatctttccggcgagcgtacaccacacaataatccccaggcgaaagggggtttctttggtttgactcatcaacatggccccaatgaactggcgcgagcagtgctggaaggcgtgggttatgcgctggcagatggcatggatgtcgtgcatgcctgcggcattaaaccgcaaagtgttacgttgattggtggcggggcgcgtagtgagtactggcgtcaaatgctggcggacatcagcggtcagcaactggattaccgcacgggtggcgatgtggggccagcactgggcgcagcaaggctggcgcagattgcggcgaatccagagaaatcgctcattgagttgttgccgcaactaccgttagaacagtcgcatctaccagatgcgcagcgttatgccgcttatcagccacgacgagaaacgttccgtcgcctctatcagcaacttctgccattaatggcgtaaacgttatcccctgcctgaccgggtgggggataattcacatctatatatctcagtaattaattaatatttagtatgaatttattctgaaaatcatttgttaatggcatttttcagttttgtctttcgttggttactcgtaatgtatcgctggtagatatggagatcgttatgaaaacctcaaagactgtggcaaaactattatttgttgtcggggcgctggtttatctggttgggctatggatctcatgcccattgttaagtggaaaaggttattttcttggcgtgttaatgacggcaacttttggcaactatgcatatcttcgcgcagaaaaacttgggcaactggatgatttttttatccacgtctgtcagttggtagcgttaatcactatcggtctcttgtttatcggtgttttaaacgcacctatcaatgcttatgaaatggtgatctaccccatcgccttttttgtctgcttgtttggtcaaatgcgtttgtttcgctcggcatgagcaacataaagttcttacacattcaggaatgaaaggaatactgtgatggacaacaaaatatcaacctattctccggcatttagtattgtttcatgggtagcccttattggcggtattgttacctatctgttaggactatggaatgcagagatgcagttaaatgaaaaagggtattattttgccgtactggtattaggtttgttttccgcggcgtcttatcaaaagaccgttcgggacaagtatgaaggcatacctaccacccccatttattatatgacttgcctgacggtctttattatctctgttgcgttgttgctggtaggtctatggaatgcaacgttattactcagcgaaaaaggcttttatgggctggctttcttcttaagcttgtttggtgcagtagcggtgcagaagaatattcgtgatgccggaataaacccaccaaaagaaacacaggttacccaggaagaatacagcgaataattcacataagcccggttagtccaatgtaaccgggcttttactaactcactaatctgtttctgtcgattcgttgtaccagcatagaaagtaacaaactcgctgccaacgtcgcgcaaaagatccaaataatatcgagtattggccagtttttaagctcaatcccccgggtgcgcagtgcatggataatcaatgcatggaacccgtatatacctaacgaatggcgggagattaagccaagtccgcaaatggtacgcgtatacagcgtgtttttaaccagagtcaataacgcgattgcgcagataaaaaccatcggcccacagtaaagataccaggtatcggcaaaatttccgcgccactgtaattcatataatgtcccgcgagagataataaaaacccccgtcgcaaacagtgcggcgctcacccacgacagtgctttatgctgtgtgtccatcatccctatagcgcggcccaacatgccataaaggatgtagtaaaaagtatcgccattgatatataagttaattggcagccattcaaaaccgtcgattttctgcggcacagtatttgggttagcgatgataccaatcaccaccattagcaccagcaacatttttccgccgacgttcttcacctgaatcagcggtgaaaccagataaatcactgcaatcgcgaagaaaaaccataaatggtaaaacactggcttttgcagcaggtttttcagcgctaactccacattgatggaggtaaatagcgcaatgtagagcagcgcaacagtgctataaaacagcaggcataagccgatgcgcaagaaatggcgcggctgggcgctgcgttcgccaaaaaagagatagccggaaatcatgaaaaatagcggcacgctgacacgagaggcagaattcagaacattggcgatatcccatgtgacggggctaacactatgagcattggtcacataccaggtggtggtgtgaatcatcaccaccattaaacacgctatccctcgcaggttatcaatccagtaaattttgggctgcatctgtgtctctgtatctggttaaaaaaagtctgaccgataaatcattcggttggcgcactggaataatctgagttttatcactacagcttatagaggcttaaggaaattcgtaagatatcagccactataccgatataaataataagactcacctgcaaaccagacggtaatttaatgatgatgaacgctttctttccggcaatggcgcttatggtgcttatggcgctagtgggttgttctacaccgccacccgtgcagaaagcacaacgggtaaaggttgatcctctgcgttcgttgaatatggaagcgttatgcaaggatcaggcggcaaaacgttataacaccggcgagcaaaaaatcgacgtcaccgccttcgaacagttccagggaagctacgaaatgcgcggttataccttccgtaaagagcagtttgtctgttcttttgacgcagatggccattttttgcatctttccatgcgttaagccctgctttttcccgtttcgtactgtatatcttccatccagcgggtatactgatcccttcctttaaatccacacgtatccagcacgaaataatatgcaaaagtttgataccaggaccttccagggcttgatcctgaccttacaggattactgggctcgccagggctgcaccattgttcaaccattggacatggaagtcggcgcgggaacctctcacccaatgacctgtctgcgcgcgctggggccagaaccgatggcggctgcttatgttcagccttctcgtcgcccgaccgatggtcgctacggcgaaaaccccaaccgtttacagcactactatcagttccaggtggtcattaagccatcgccggacaatattcaggagctgtaccttggttctctgaaagagctgggcatggacccgaccatccacgacatccgtttcgtggaagataactgggaaaacccgacgctgggtgcctgggggctgggctgggaagtgtggctgaacggcatggaagtgacgcagttcacttacttccagcaggttggtggtctggagtgtaaaccggttaccggcgagatcacctatggtctggaacgtctggcaatgtacattcagggcgtagacagcgtttacgacctggtctggagcgacggcccgctgggtaaaaccacctacggcgacgtgttccatcagaacgaagtggagcagtccacttacaacttcgaatacgcggatgtggacttcctgttcacctgcttcgagcagtacgagaaagaagcgcagcaactgctggcgctggaaaatccgctgccgctgccagcctacgagcgtattctgaaagccgcccacagcttcaacctgctggatgcgcgtaaagccatctccgtcaccgagcgtcagcgctatattctgcgcattcgcaccctgaccaaagcagtggcagaagcatactacgcttcccgtgaagccctcggcttcccgatgtgcaacaaagataagtaagaggcggctatgtctgagaaaacttttctggtggaaatcggcactgaagagctgccaccaaaagcactgcgcagcctggctgagtcctttgctgcgaactttactgcggagctggataacgctggcctcgcacacggcaccgttcaatggtttgctgctccgcgtcgtctggcgctgaaagtcgctaacctggcggaggcgcaaccggatcgtgaaatcgaaaaacgtggtccggcaattgctcaggcgttcgatgccgaaggtaaaccgagtaaagcggcagaaggttgggcgcgtggttgcggtattaccgtggaccaggctgagcgtctgactaccgataaaggcgaatggctgctgtatcgcgcccatgtgaagggcgaaagcaccgaagcactgctgccgaatatggttgcgacttcgctggcgaaactgccgatcccgaaactgatgcgttggggcgcgtctgacgtacacttcgtgcgtccggttcacactgtaaccctgctgctgggcgacaaagtcattccggctaccattctgggcattcagtccgatcgcgtgattcgcggccaccgctttatgggcgagccggaatttactatcgacaatgccgatcagtatccggaaattctgcgtgagcgcgggaaagtcatcgccgattacgaagaacgtaaggcgaagattaaagccgatgctgaagaagcagcacgtaagattggcggtaacgctgatttaagcgaaagcctgctggaagaagtggcttcgctggtggagtggccggtcgttctgaccgcgaaattcgaagagaaattcctcgcggtgccgtctgaagcactggtttacaccatgaaaggtgaccagaagtacttcccggtgtatgcgaacgacggcaaactgctgccgaactttatcttcgttgccaacatcgaatcgaaagatccgcagcaaattatctccggtaacgagaaagtcgttcgtccacgtttggcggatgccgagttcttcttcaacaccgaccgtaaaaaacgtctggaagataacctgccgcgcctgcaaaccgtgctgttccagcaacagctgggtacgctgcgtgacaagactgaccgcatccaggcgctggctggctggattgctgaacagattggcgctgacgttaaccacgcaacccgtgcgggcctgctgtctaagtgtgacctgatgaccaacatggtcttcgagttcaccgacacccagggcgttatggggatgcactacgcgcgtcacgatggcgaagcggaagacgtagctgtcgcgctgaatgagcagtatcagccgcgttttgccggtgatgacctgccgtccaacccggtagcctgtgcgctggcgattgctgacaagatggataccctggcgggtatcttcggtatcggccagcatccgaaaggcgacaaagacccgtttgcgctgcgtcgtgccgcacttggcgtgctgcgtattatcgttgagaagaacctcaaccttgatctgcaaacgctgaccgaagaagcagtgcgtctgtatggcgataagctgactaacgccaacgtggttgatgatgttatcgactttatgctcggtcgcttccgcgcctggtatcaggacgaaggttacaccgttgacaccatccaggcggtactggcgcgtcgtccgactcgtccggctgatttcgatgcccgtatgaaagcggtatcgcacttccgtaccctggaagcagctgcagcactggcggcggcgaacaagcgtgtatctaacatcctggcgaaatctgatgaagtgctgagcgatcgcgtgaatgcctctactctgaaagagccggaagaaattaaactggcgatgcaggttgtggtgctacgtgacaagctggagccgtactttgcggaaggtcgttaccaggatgcgctggtcgaactggctgagctgcgtgaaccggtcgatgctttcttcgataaagtgatggtcatggttgatgacaaagaattgcgaatcaaccgtcttaccatgctggagaaactgcgcgaattattcctgcgcgttgcggatatttcgctgttacagtaataatgccgttattaaatagcctgccatctggcaggctttttttatcgctaaataatacagcaacctttaataatcttctgatgaataaagattatctcatatattaattttatgagatttttttaggattatatcaaggagaagaaacgaacttattaagctagaatagccacgggtgcttgagactgtttgtctcaggtattcaccgaaaggcagacagagaaaagccccacctgactataaatcaaagtgaggcccctctatgcatagacaccataaggttagcctcttactcgttggaaatcaacacagggggctgggaatgccgcagaaatatagattactttctttaatagtgatttgtttcacgcttttatttttcacctggatgataagagattcactgtgtgaattgcatattaaacaggagagttatgagctggcggcgtttttagcctgcaaattgaaagagtaagcgtcttcggcgggaaattattcccgcctttcttacggtgttgcgcattctcattgcacccaaatttattcttcacaaaaataataatagattttattacgtgatcgattatttatttcctgaaaaacaaataaaaaaatccccgccaaatggcagggatcttagattctgtgcttttaagcagagattacaggctggttacgttaccagctgccgggcctttagcgccgctttcgatggtgaaggacactttctgaccttcgtccagagatttgtaaccatcgttctggatagcagagaagtgtacgaacacgtctttagagccatcgtcaggagtgatgaagccgaagcctttgtcagcgttgaaccattttacgataccagtcattttaccggacatagtgtattacctttaataattaagtgtgcctttcggcgatatggcgtgctttacagattttgaagcgttaaaggaatgtgcactacgaggggtatcaacgataactcttgaagggacttgccttactacactgctttaatggtctgtacgtcaaaccgttgatgtgcattaagccacgcattggcgggtgatgcaacaattatttttcatatttatgattaatcggttggaaaacggtcctgtcatcaggaccgtaaacagcaataaagtggataaaagcctattccatcaactgcttacttaatgccgggttggcttgaatcaaacgcatcagttttagttcggcacttgaaggcttcacgcgtctggattcccattcctttaccatggcgactgatacgcccaaaacccgggcgaaatcatcgatttttaatcctgtcccttttcgtaactgctcaatttcggtacaggacgttgttctgtgcgtcagggtaattttctgcgtttcatctttaaaaacaatctgttccaggctgctcaacagctcatgcattggatctttatattccattgaaaactcctcaaatcacactgcgggatcgtgaattgcatcgaagctcattaagaatagtcgggaaaaacagacacagcggggtgttgtcagggcatactctgactatgattcgattcagccagtcatttagcgtgacttatagccacctaacgatctgataaatgccgatatatctcttaccactcccggtttgtaaagatttcgaaaatctaacgttctgcgaaggcgtaaatctctggctacaaaaaaagcaacagcaatatcattttttaacaatgaaacaacaaattaaccttgtttcattttctccatgattttaccaggaagattacgtagaaagggtatcctgcaagcctgtcctggactatccttgtcacgtcagacacgcgtgtgtcgttgtgcgctttttttgggtgaaaggagtaagaaaatggcgacaggaaagtcctgctctcgctggtttgcgcctcttgcggcgttattaatggtagttagcctgagtgggtgttttgataaagaaggcgatcagcgtaaagcgtttatcgacttcctgcagaatacagtgatgcgtagcggtgaacgtctaccaaccctgactgccgatcagaaaaaacagtttggtccttttgtctctgattacgcgattctgtatggttattctcagcaggtgaatcaggcgatggattccggtctgcgcccggttgtagacagcgttaacgcaattcgcgtaccgcaggattacgttacgcaaagcggtccgctgcgtgaaatgaacggttcgctgggtgtgctggcgcaacagctgcaaaatgcgaagttgcaggccgatgctgcgcactctgcgttaaaacagagtgatgacctgaaaccggtctttgatcaggcattcaccaaagtggtaacgacgccagctgatgcattgcaaccgttgattccggcggcacaaactttcacgcaacaactggtgatggttggagactacattgctcagcaaggtactcaggtgagctttgtcgcaaatggcatccagttcccgacttcacagcaggcaagtgaatataacaaactgattgcgccattaccggcacaacatcaggcgtttaatcaggcctggactacagcagttactgcaacccaataaagagtaaaagcccgagcgattatcgggctttactccacgcagtcgcggcttagtccgcgacgtgcggattcacacagttcttctcaacctttccttgtaacgcatcaatcaaattatccacggcacaggcggccatgccataacgcgtctcatgagtggcagatccaatatgcggtactgcgacgacattggccattgagagcaacggcgaatctacggacagtggctcttgttcgaagacatccagcccggcggcgtgaatttctcctttctgcaatgcagcaatcagtgcattttcatcaaccaccgggccacgtccggcattaatgaaaatggcggaggatttcattttgccgaattgttctgcgccaaatagatgatacgtctcatcagttaacggcaggatcaggcaaacgaaatctgactcttgtaacagtgtatccaaatcgcagtagcgggcgttgaagcgttcttctgcttctttatggtggcgacgcgcgttatagaggatgggcatgttgaagccaaagtgcgcacgttgtgccagcgccatgccgatccgtcccatcccgacaatgcccagtgttttatggtgaacgtcagtgccgtaccagtccgggcctatgctcgcggtccattcgcctgcttttacccgttctgctacctccacaacccgacgagcggtagacaacaccagcgccatcagcgtatcggcgacggtttctgttaatacggttggtgtgtgcatcagcagaatttttcgggcggtaagcgcatcgacatcaaaattgtcatagccgacggagatcgttgatgtggcacgcagtttcggcattttttccagcaatgcggcatcaacattctcatttgaacccagcaagccttcagcttcggcaaaaattgctgcattttgttcgacggtttgtgggctgaggtttgccacctggtgaacggtgaaatgttcttgcaggcgttgcagtaaatcatcaggtaaggctttgtagaggataacggacggcttcatgcttctctccattcactgataaggcgatcaccttagcctgaaatatgatgaaggaaaactgaagaatgccaggtgatttctgcatcacctgacatgaaagggattacagtgggcttaaggtaatttctacacggcggttttgcgccttaccttctgcggtgctgttgctggcgattgggttagccgggccaaggccctgagtacggatgcggctggcgtccacgccctgggtgatcaacgcgctggcaacggaatccgcacgctgctgggagagacgcatgttcaggtcgtgaccccccgtgctgtcggtataaccaatcacgttaaccgccgttttcggatactctttcagtaccattgccacgccggtcagggtgttagcgcccgccggtttcagggttgcgctgctgctgtcgaaggtcacattgttcggcatattgaggataatgttatccccgctgcgggttacgctaacaccagtgccgcgcattttgtcacgcagcttcgcttcctgcacatccatgtaataaccaacgccgccgcccagagctgcgcctgctgctgcgccaatgagcgcgcctttaccgcgatctttcttcgaagaagagagcgcaccaatacccgcgccaacgagagagcccagacctgcgccgatagcagatttacctgcttcgcgttcgccggtgtaagggttagttgtacagccagataccgccagagcgccactcactacggcggcaataagataaacacgtttcttcattgttaatccttaataacctttttattctttgccacgggttccgtggcgggagattatgccgcgtgagcatgaagattattcctgggaatactcggaaatttgtaagtaatatttaactgctcaatacatctaacctttcaggagtcttcggtttggccaactcatcctcacgatattccgttctgactgccgcccactgggggcctatgctggttgaaaccgacggcgaaaccgtgtttagctcgcgtggcgcgttagccacaggaatggaaaactccttgcagagcgcggttcgcgaccaggttcacagcaatacgcgggtgcgatttccaatggtgcgcaaaggctttcttgcgtcaccggaaaatccgcaaggcattcgtgggcaggatgaatttgttcgcgtgagttgggatgaggcgctggagcttattcaccatcaacataaacgcattcgtgaggcttatggcccggcatcgatttttgctggttcctacggctggcgttcaaacggcgtgctgcataaggcctcgacattattacaacgctatatggcgctggcaggcggttatactgggcatctgggggattattcgaccggcgcggcacaggcgatcatgccgtatgtcgtgggtggcagcgaagtttatcaacagcaaaccagttggccgctggtgctggaacatagcgatgtcgtggtgctgtggagtgctaacccactcaatacgctgaaaattgcgtggaatgcatccgatgagcaggggctttcttacttttccgcactgcgtgacagcgggaaaaagctgatctgcattgatccaatgcgatcggaaaccatcgatttctttggcgataaaatggagtgggtggcaccacacatgggcaccgatgttgcgttgatgctggggatcgcccatacgctggtggaaaatggttggcacgacgaagcgtttctggcgcgttgcaccacaggttatgccgtcttcgcctcttatttgctgggcgagagtgacggtatagcgaaaaacgccgaatgggcggcagagatttgtggtgttggcgcagcgaaaatccgcgagctggcggctattttccaccaaaatacaaccatgctgatggcaggctggggaatgcagcgccaacagtttggtgagcaaaaacactggatgctcgtcacgctggcggcaatgttggggcaaatcggcacacccggcggcggttttggtctttcttaccattttgccaatggtggtaaccccacgcgccgcgctgcggtgctctcttccatgcagggcagcttgccgggtggcaccgatgcggtagataaaatccctgtcgcccgcattgttgaagcactggaaaaccctggtggcgcatatcaacataacggtatggaccgacatttcccggatattcgttttatctggtgggcgggtggtgccaactttactcatcatcaggataccaatcgcctgatccgtgcctggcaaaaaccggagctggtggtgatctccgaatgcttctggacggctgcggcgaaacacgcggatatcgttctgcctgcgacaacctcttttgagcgtaatgatctcaccatgaccggtgattacagtaatcagcatctggtgccgatgaagcaagtggtgccgccacgcgatgaagcgcgtaatgattttgatgtttttgccgacttgagtgaacgttgggagaagggtggttatacacgttttacggaaggaaaaagtgagctgcaatggctggaaacgttttataacgttgcccggcagcgcggggcaagccagcaggttgaattgccaccatttgctgagttctggcaagccaaccagttaattgagatgccggaaaacccggacagtgagcggtttattcgcttcgccgattttcgccgcgatccgcaggcgcatccattaaaaaccgccagcggtaagattgaaatcttctcgcagcgtattgccgattacgcttatccggattgcccggggcatccaatgtggctggcgccggacgaatggcagggcagtgccgaaccggaacagttgcaggtactttctgctcatccggcgcatcgtctgcacagccagctgaattacagttctctgcgcgaattgtacgcggtggcaaatcgtgagcctgtcaccattcatcctgacgatgcccagacgcgcggcatacaagatggcgatactgttcggctgtggaactcacgcgggcaaattcttgctggagcggtcattagcgagggaattaaacctggcgtgatttgtattcacgaaggcgcatggccggatttggatttaatcgctggcggcatttgtaaaaacggcgcagtgaacgtgctgaccaaagatctccccagctcgcggctggggaatggctgtgcgggtaatacggcgctggcatggctggaaaaatacaccggtccggaactgacacttacagcgtttgaaccaccggccagctcataatccaggtgggtagttgggtttcatcctgccatgcgcaatcgacaatgtgaaaaccctgcgcatggtagaaatctatcgccggttgatttttttgataaacctccagcatcagatggggatggcgctgctgcacatactgcattagcgccttaccaataccgcgtctgacggccttcggtgcgacaaacattgctgcgaggaatcggccttccataatgctgacaaaaccgagaagcttaccgtcttcttcccagacccagttttgcgcgttggcaagatacgcatcccgcaccagcggaatgcagtcacgccagtaactcgattttataaagggatgcccccaggttgtactttccagccacagttggaggatcgcggggagttctgaacgttgcacttcccgaatcatggtttatttcccggatggcaacagcagccaaccacatgatcattcaccagcccacatgcctgcataaaggagtaacagattgtggtaccgacaaacttaaaaccacgtttttttagtgccttagatagggcgtcggaggcgggtgtagatgtggggatttcgctcaacgttgtggcttgtgtcacctgtggttgatgattgacaaacgaccagacaaagtcggcaaacggttcgccgttctgttccatttgcaggtacgcccgcgcattaccaataattgcctgaattttcccacgatggcggataatcccggcgtcctgtaccagtctttcgatatcctcttcctgcattgcggcaactttcaccggatcgaactgatgaaagcatgcgcgatagttttcgcgttttttgaggacggtgatccacgataacccagcctgctgcccttcaaggcagatcatttcgaacagttttttactgtcagtttcaggcacgccccattcattatcatggtaggcaatataaagcgggtcctgactcacccagccgcaacgttccatactttccctcgctatgtacccgatcgtaaaaatttcagccgcttttcttgacgcatcggtgaaaaagtcaatatttaatacagggctactatgcccgatatccttcatacaatgacaataatattgccgaattcggctcttctctggagtcgtgttaatgatcataaaaaaaagcggtggtcgctggcagctaagcctgcttgcgagcgtggtaatcagtgccttttttctcaacacagcttacgcctggcaacaagaatatatcgttgatacgcaacccggacattccacagagcgttacacctgggatagcgatcatcaacctgattacaacgatattttgtcgcaacgtattcaaagtagccaaagggcgctgggactggaagtcaatctggcggaagaaacccctgtggatgtgaccagcagtatgagtatgggctggaattttcctttatatgagcaggttacaaccggcccggtcgcggcatttcattacgatggcacaaccacctcgatgtataacgagtttggcgacagtactaccacgctggccgatccgttatggcatgccagcgtgagtaccttaggctggcgtgttgactcccggcttggcgatctccgaccctgggcgcaaatcagctataaccagcaatttggcgagaatatctggaaggcgcaatcaggcctgagccggatgacggcgacaaaccagaacggcaactggctggatgtcaccgtaggcgctgatatgttgctcaatcaaaatattgctgcctatgctgcgctatctcaggcagaaaataccactaacaatagcgactatctgtatacgatgggggttagcgccagattttaacgttatagatacaattgaaaccgataaataacaactaatgtggcgatagtggggactaacttactaaataataaatttggcgaataattgtcgagtcattcattcctgaactaatgcatttcattccgttctgatggcatttcatgccgtttttccccaggcataaagcgcacttcgttatggttgtcagcagagatttttcctttttattactgcaggaatactgccatgacaccttcaaattatcagcgtactcgctggctgacactcatcggtactatcattacccagtttgctctggggtcggtttatacctggagtctgtttaacggtgcgctttctgccaagctgggggctcctgtaagccaggttgctttctctttcggcttgttaagtctggggctggcaatttcgtcttctgttgcgggcaaattgcaggaacgttttggtgttaaacgcgtcactatggcttccggcattttgctgggattaggtttcttcctgacagcacattccaacaacctgatgatgctgtggttaagcgccggtgtgttggttggtctggcggatggtgcgggttacctgttgacgctctctaactgcgtgaagtggtttccggagcgtaagggacttatctctgcttttgctatcggttcttatggtctgggcagcctgggttttaaatttatcgacacgcacctgctcgaaacggtgggtctggaaaaaacctttgttatttggggcgcgattgtactggtgatgattgtctttggcgcaacgttaatgaaagatgcgccgaagcaggaagtgaaaaccagcaatggtgtggtggagaaggactacaccctggcagagtcgatgcgtaaaccgcagtactggatgttagcggttatgttcctgactgcgtgcatgagtggtctgtatgtgattggtgtagcgaaagatatcgctcaaagtctggcgcatcttgatgcaatttccgcagccaatgctgtgacggttatttccatcgccaacctttctggtcgtctggtgctgggcattctgtctgacaaaatcgcccgtatccgtgttatcaccattggtcaggtgattgcgctggtggggatggcggccctgctgtttgcaccattgaatgcagtgacgttctttgcagcgattgcctgtgtggcatttaactttggtggcacgattactgtgttcccgtcgctggttagtgagttcttcggcctcaataacctggcgaaaaactacggcgtcatttacctcggtttcggtatcggcagcatttgtggttcgattatcgcttcactgtttggcggattctatgtgactttctacgtgattttcgccctgctgattctgtcactggcgctttctacgaccattcgccagccagagcagaaaatgttgcgtgaggcgcatggctccctttaatcatctgccgcgagctactgggcttcagcttcagtgtgcatcaaacgcatcaacgaaatgtataaacaataacgcgtaaaatttgggccagttagctggccctttttactgctttttgtaacgctaaagtctcttttcaaacttgcatttttgtaaatttgtgcttcgtgcacactctttccccacactttttccctttgctgtggtctacttattcgcgcgtgtagattttacttatctgactacctccgcacttttcccctgcctggcctgaaaagccactaagcagggtgttatcacctgtttgtccagggtttgtttgcatgagatacatcaaatcgattacacagcagaagctgagcttcttgcttgcaatctatattggcctttttatgaatggcgcggttttttaccgccgcttcggcagctatgcgcacgattttaccgtctggaaaggtatttctgctgttgttgaactggccgccaccgtactggtgaccttctttttactgcgtcttctttcgctgtttggccgccgcagctggcgtattctggcatcgctggtggtgctcttttccgcaggtgccagctattacatgaccttccttaatgtagtcattggttatggcatcatcgcatccgtcatgaccaccgatatcgacctgtcaaaagaagttgttggtctgaactttattctctggttaatcgccgtaagcgcgttgcctcttatccttatctggaataaccgctgtcgttacaccttgctccgacaactgcgaaccccagggcaacgtattcgcagcctggcggtcgtcgtactggcaggtattatggtttgggcaccgattcgtttgctggatatccagcagaagaaagtggagagggcgacaggtgttgatttgccgagttatggcggcgtcgtcgcgaactcttatctgccatcaaactggctttcggcattaggtctttatgcctgggcgcgggtcgatgaatcttccgataacaattctctccttaaccctgcgaagaagtttacgtaccaggctccacaaaacgttgatgatacatatgtcgttttcattattggtgaaaccacgcgctgggatcatatgggcattttcggctatgaacgcaataccacaccgaagctggctcaggagaaaaatctggcggcgttccgtggttactcctgtgatactgcaaccaaactctcactgcgttgcatgtttgtacgtcagggtggagcagaagataatccgcagcgcacattaaaagaacagaacattttcgcggtattgaagcagttaggattcagttctgatctctacgctatgcaaagcgaaatgtggttctacagcaatacgatggcggacaacattgcttatcgtgagcagattggtgcggagccacgtaaccgtggcaaaccggtagatgatatgttgctggtagacgaaatgcagcaatcgctggggcgcaacccggatggtaagcatctgatcattctgcataccaaaggctcacactttaactacacccagcgttacccgcgcagctttgcgcagtggaagccggaatgtattggtgttgatagcggctgtaccaaagcgcagatgatcaactcatacgacaactcggtgacctatgtggatcactttatttccagcgtgattgatcaggttcgcgataagaaagcgattgtgttctatgcagctgaccacggtgagtcaattaatgaacgcgagcacctgcacggcacgccgcgtgaactggcaccgccggaacagttccgtgtgccgatgatggtctggatgtcggataaatatctggaaaatccggtcaatgcgcaggcatttgcgcagctgaaaaaagaagccgacatgaaagtgccacgccgtcatgtagagctgtacgacaccatcatgggttgtcttggctatacttcaccggatggtggaattaacgaaaacaacaactggtgtcacatcccgcaggcaaaagaggcgtcggctaactaggcctgctgactttctcgccgatcaaaaggcattttgctattaagggattgacgagggcgtatctgcgcagtaagatgcgccccgcattcggtgattggcgcagcctggtagcgcacttcgttcgggacgaaggggtcggaggttcgaatcctctatcaccgaccaaattcgaaaagcctgctcaacgagcaggcttttttgcatctgtagctcatgaggaagagaacctccgggggcggggaggttcgactcgacgtaggcctgataagacgcgccagcgtcgcatcaggcaaatgtaccggcccattgtcggatgcggcgcgaccgccttatccgatctacacaccacacatttccctgccaaatttgcgccccatatctcactatccattaacggatttgtgacagaaaccattgtctttttttatatttgcttaaatctttttttgcgttacttatggctggcgctggcattttccgctgtgcgttttagcgttcatggtattaatcgctcagatatccacctttacctcagatttttttcattaaatgcataaaacttaatcaccaaatgttgctaaatattaagctgattgttctggttgtgttggcgtagcacaaatttctctgctgcaaatagctgtttgaagtttttttaatctttgtttgtggattctcaccgttggtgtaaatcccggttggctgtattgacgttttcacattctgttgacagattgtaggtcacgaggggcattttatggaggatccgcactgttacactgatgttaattagtacggcatccccacctcataacgttgacccgaccgggcaaaaaacaaaaaaggtcaggcagcgacaacccactgcaaagggttaaaacaacaaacatcacaattggagcagaataatgcgtatttccttgaaaaagtcagggatgctgaagcttggtctcagcctggtggctatgaccgtcgcagcaagtgttcaggctaaaactctggtttattgctcagaaggatctccggaagggtttaacccgcagctgtttacctccggcaccacctatgacgcctcttccgtaccgctttataaccgtctggttgaatttaaaatcggcaccactgaagtgatcccgggcctcgctgaaaagtgggaagtcagcgaagacggtaaaacctataccttccatctgcgtaaaggtgtgaagtggcacgacaataaagaattcaaaccgacgcgcgaactgaatgccgatgacgtagtgttctcgttcgatcgtcagaaaaacgcgcaaaacccgtaccataaagtctctggcggcagctacgaatacttcgaaggcatgggcttaccagagctgatcagcgaagtgaaaaaggtggacgataacaccgttcagtttgtgctgactcgcccggaagcgccgttcctcgctgacctggcaatggacttcgcctctattctgtcaaaagaatatgctgacgcgatgatgaaagccggtacaccggaaaaactggacctcaacccaatcggtaccggcccgttccagttacagcagtaccagaaagattcccgtattcgctataaagcgtttgatggctactggggcaccaaaccgaagatcgatacgctggtcttctctattactcctgacgcttccgtgcgttacgcgaaattgcagaagaacgaatgccaggtgatgccgtacccgaacccggcagatatcgcccgcatgaagcaggataaatccatcaacctgatggaaatgccggggctgaacgtcggttatctctcgtataacgtgcagaaaaaaccactggatgacgtgaaagttcgccaggctctgacctacgcggtgaacaaagacgccatcatcaaagcggtttatcagggcgcgggcgtatcagcgaaaaacctgatcccgccaaccatgtggggctataacgacgacgttcaggactacacttacgatcctgaaaaagcgaaagccttgctgaaagaagcgggtctggaaaaaggtttctccatcgacctgtgggcaatgccggtacaacgtccgtataacccgaatgctcgccgcatggcggagatgattcaggcagactgggcgaaagtgggcgtgcaggccaaaatcgtcacctacgaatggggtgagtacctcaagcgtgcgaaagatggcgagcatcagacggtaatgatgggctggactggcgataacggggatccggataacttcttcgccaccctgttcagctgcgccgcctctgaacaaggctccaactactcaaaatggtgctacaaaccgtttgaagatctgattcaaccggcgcgtgctaccgacgaccacaataaacgtgttgaactgtacaaacaagcacaggtcgtgatgcacgatcaggctccggcactgatcatcgctcactccaccgtgtttgaaccggtacgcaaagaagttaaaggctatgtggttgatccattaggcaaacatcacttcgaaaatgtctctatcgaataattaaagccatgcaagactgatggcaaaggcaaaactgcctgatgcgctccgcttatcaggcctacgaaaactctgcaatgtattgagtttgcacgattttgtaggtcggataaggcgtttgcgccgcatccggcataaacaaagcgctctttgtcaacaatctgcatacccggtggcgctgtgcctctgcgtgcagcgccatccggcagcaatacttcattccctgttccacaagggcgggaattgatttgtgagcaatacagacacgcagttccaggctgcgggtcactatagagaatccgggttatgttgcagtttattctccgacgtttgggactcgtcatccccacgtttatcggtattacccttctcacatttgcctttgtccacatgatcccgggcgatccggtgatgatcatggcgggcgaacgtgggatctccccagagcgtcacgcgcaattgctggctgaactcggcttagataaaccgatgtggcagcagtatctccattacatttggggcgtaatgcacggtgatttaggcatttccatgaaaagccgaattccggtatgggaagagttcgtgccgcgctttcaggccacgctggaacttggcgtctgcgcgatgatttttgcgaccgcagtcgggattccggttggtgtgctggctgcggttaaacgtggttccattttcgatcacacagcggttggcctggcgctgaccggctactcgatgccaattttctggtggggcatgatgctgatcatgctggtttcggtgcactggaacctgacgcctgtctccggtcgtgtgagcgacatggtgttcctcgatgattccaatccgttaaccggttttatgctgatcgacaccgccatctggggtgaagacggtaactttatcgatgccgtcgcccatatgatcctgcccgccattgtgctgggtaccatcccgctggcggtcattgtgcgtatgacgcgctcctcgatgctggaagtgctgggcgaagattatatccgcaccgcgcgtgccaaaggtcttacccggatgcgggtgattatcgtccatgcgctgcgtaacgcgatgctgccggtggtgaccgttatcggcctgcaggtgggaacattgctggcgggggcgattctgactgaaaccatcttctcgtggcccggtctggggcgctggttgattgacgcactgcaacgccgcgattatccggtagtgcagggcggcgtattgctggtggcgacgatgattatcctcgtcaacctgctggtcgatctgctgtacggcgtggtgaacccgcgtattcgtcataagaagtaaggggacatcatgtcacaggttactgaaaataaagtgattagcgcaccggtgccgatgaccccgttacaggagttctggcactattttaaacgcaacaaaggcgcggttgtcgggctggtttacgtcgtcatcgtgctgtttatcgcgatctttgccaactggattgcaccctataacccagcggaacagttccgcgatgcactgctcgccccgccagcctggcaggaaggcggcagcatggcgcacttgctgggcactgatgacgtggggcgtgatgtgctgtcgcggctgatgtacggcgcgcgcttgtcgctgctggttggctgtctggtagtggtgttatcgctgattatgggcgttattctcggcctgatcgctggttactttggcggtctggtcgataacatcatcatgcgcgtggtcgatatcatgctggcgctgccaagtctactgctggcactggtgctggtggcgattttcggcccgtcgattggtaacgccgcgctggcgctaaccttcgttgcgctgccgcattatgtgcgcttaacccgcgccgccgtgctggtggaagttaaccgcgattacgtcaccgcgtctcgcgtggcgggtgccggggcaatgcgccagatgtttattaacatcttcccgaactgccttgcgccgctgattgttcaggcgtcgctcggtttctctaacgccattctcgatatggctgctcttggtttcctcggcatgggcgcgcagccgccaacgccggagtggggcaccatgctctctgacgtgttgcagttcgcgcaaagcgcctggtgggtcgtgaccttcccgggtctggcgatcctgctgacggtgctggcatttaacctgatgggtgacggtctgcgtgacgcgctcgatcccaaactgaagcagtaagaggttcgagatggcgttattaaatgtagataaattatcggtgcatttcggcgacgaaagcgcaccgttccgcgccgtagaccgcatcagctacagcgtaaaacagggtgaagtggtcgggattgtgggtgagtccggctctggtaaatcggtcagttcgctggcaattatggggctgattgattatccgggccgcgtaatggcggaaaagctggagtttaacggtcaggatttgcagcgtatctcagaaaaagagcgccgcaacctggtgggtgccgaagtggcaatgatcttccaggacccgatgaccagccttaacccgtgctacaccgtgggtttccagattatggaagcgattaaggtgcatcagggcggcaacaaaagtacccgccgtcagcgagcgattgacctgctgaatctggtcggtattcccgatccggcatcgcgtctggatgtttacccgcatcagctttccggcggcatgagccagcgcgtgatgatcgccatggcgattgcctgtcgaccaaaactgctgattgccgatgaaccgaccactgcgctggacgtgaccatccaggcgcaaatcatcgaactgctgctggagttgcagcagaaagagaacatggcgctggtgttgatcactcatgacctggcgctggtggcggaagcggcacataaaatcatcgtgatgtatgcaggccaggtagtagaaacgggcgatgcgcacgctatcttccatgcgccgcgtcacccgtatactcaggcattgctgcgtgcgctgccggaatttgctcaggacaaagaacgtctggcgtcgttgccaggtgtcgttcccggcaagtacgaccgcccgaacggctgcctgcttaacccgcgctgcccctacgccactgacaaatgccgtgctgaagaaccggcgctgaatatgctcgctgacgggcgtcagtccaaatgccattacccacttgatgatgccgggaggccgacactatgagtacgcatgaggccacctcgcaacaaccgctgttgcaggctatcgacctgaaaaaacattatccggtgaagaaaggcatgttcgcgccggaacgtctggtgaaggcgctggatggcgtttcgtttaaccttgaacgtggcaaaacgctggcagtagtaggtgaatctggctgcggtaaatcgaccctcggtcggttgctgacgatgattgaaacgcccaccggcggcgaactgtattaccaggggcaggatctgctcaagcacgatccgcaggcgcagaagctacgtcggcagaaaatccagattgtcttccagaacccttacggttcgctgaatccgcgtaaaaaagttgggcagattctcgaagagccgctgctgatcaacaccagcttaagcaaagaacagcgtcaggaaaaagccctgtcgatgatggcgaaagtcggcctgaaaaccgagcattacgaccgctatccgcatatgttctccggcggtcagcgtcagcgtatcgccattgcccgaggtctgatgctcgacccggatgtggtgattgccgatgagccggtttctgcgctggacgtctcagtgcgtgcgcaggtgctgaatctgatgatggatttgcagcaggaactggggctatcttatgtctttatctcgcacgatctgtcggtggtggagcacattgctgatgaagtgatggtgatgtacctgggccgctgcgtggagaaggggacgaaggaccaaatcttcaataacccgcgccacccgtacactcaggcattgctctccgcgacaccacgcctgaacccggacgatcgtcgcgaacgcatcaaacttaccggtgaactgccaagcccgctgaatccaccgccaggctgcgccttcaacgcccgctgtcgtcggcgcttcggcccctgcatccagttgcagccgcagctaaaagactacggcggtcaactggtagcctgttttgccgttgatcaggatgaaaatccgcagcgttaactcacaaaaccggggccatgcgctccggtttactcaatcaacttcaacagtggcgacaagcataacaaaatgccgtacagcagaatcatccaggctttaaacccgcgaagtttttccagttgtgagactttatagatcaggaaaaacggaatgaggcacgacacaatgccatataacgggcttcccaactgaaagaacaccagtaccgatacacgaaacgaaacccaaatcgtcaacgtaatgacgataaaagtgcagatcgccagagtcagcacgagtgagttaattttcctggtatcaataattcggcttaacagattgagaataatgcctttaatggcctcgtggaaaccgagataaatgccaaagaatgcagtcagtacggcaaagatattcagtaccgtagaggtgatatgaatgatatgcccagggatcacctgcgcggccagtgccagtgccgagatattttgttcaaaggcagaaacggcttcttcgtggctaattgagaaggtaaacgaaaaggcaaaaaacaagatcaccgcaatgagcgtgatatagctaatccggtgggtacgcagcgcgagccgggttgccagtactttatccgcttcccgtttacgataggcaatattcattgggttaagtacctgaataaataccgcggaaaagaagcaaaatggaatagtaagcaggacatcgcggaaaaagtcggaggcttgcgggaaggcggttatattggcgaaattccagtgcgggatcatcgcaaaaccgaacacgacaataatccccactttgaccaccaccattggtccggaaatcttaaacagtaatcgttcaccaccagacgcaatcgccaccagtacggcgaaaatggcgactttataaaatagagattgagaaagatcggcatcggttaaaccgaaggttttcaggtacgaggcgctgtcgaaaaccacggagagagagtagataaaaatcccgtggataatcatcaaaaagtagataaccccgaggaaaattccccagttcttccccaggtaatgactgataatatcggtgtagtcattacaggaatcgctttcagaaagggtttttaaataaatgtcctgtactacccaggtggcaggataagcaatgatcgctgcggtaataaatacccaaattcccttcaagccaatttgtactggcatcagcacggttccggcaccaatcgccatgcctatgcataataaaacccagccgaagtcgtagcgtgtaaacggcaatttctgatcgtgtttcggtagtgtgttgtgctgcataaagtcctgtccagaaagaagtcggcctcgcaaaaatgaataaacccagtttctcttgcgcaacaggtggagaagtcgaatacgcagtatgtaaaaaatgaggcaacagattcactggggaggtcgcgaggaggcgcaattctacaaaattgcgcatttcactactagtctggagtcagcccggatatgagctgcaactattgcaaataaagaaattaagctggaaggcatcacgcaatgaggaagattgccgggtgctgacggcaaaaaacaatcgtaaaatcagcggcaagccggaaaggttccggtgaggcgcaatgttgcgggggctttatccctggtggcattggttgctggagagagaaaacccccgcacgttgcaggtatgcacctgacaatatcacgggggctaatcttgaacctagaccactcaagaatagccgcgaaacgttgtcattacaacacaggcggctatatgacgctcgcagaactgggcatggccttctggcatgatttagcggctccggtcattgctggcattcttgccagtatgatcgtgaactggctgaataagcggaagtaacgtgtcatgcgggcgtcaggctgccgtaatggcaatttgcgtccggatcaggccgcaggggtgaaactctgcggcctttttcgttcttattgcgggtaaggcacccagtcgccgccgttcaggcgaacgtacggtttatcctggtattgaataactactgcatttgagttctcggagaccggtgctgtttgtggcaacccactggtgagttttttccagtcaacattgtcttcggagaaaatcttgccatcaagaacgcgaaccaccagatcggagatagccaggaagctgctcggttggtcgatgacaatcggtgccccctgatgtggtgccttcatgccgaagaatttcaccccaacggggacgtctgtgatagacgggctagggatatcacgtagaccagatacctgcattctgtcgcccttcagcgcgccgccgtgttccggcaccacgaccaccatcactttacgacccgatttctccagttcagtaaagaaggcgtccagttcatcaaagaatttttgcgcccgcgctttgtaatccgctgttttgctgacgcccggataatggttgccgtcatgcagtggaagcgtgttgtagaacgtggcactacggctgtttttatctttttcggtaacgtccagccaacggttaagcacggcggtatcgtcataaaccggcgaaccatcaaagcccagcaaaataaccggcagatttgtttgatccatcaattcgctctgcatgccgccattttcgcgaacttctttcaaaaaaccgccgaactggccgttatgtcccatcatcaggtgctgggtaaagcccagtttcgacaggttatcaaacagatagcagtcgttatttgccggttgatacagattagtgtgcgaagtctgcccgcagctggcgcgcagtaaacggatcgccgccgggccactgtaggaggtggcggagttaaagttcttgaactcaatatcgaaatgcgaccacagtggatgcgacatcaatccggcggcttcaatatccgaccaggaaagcgaacagatattaatcaccagtagttcaaatggctgagcatcagcgggcagcgaagacgggaagatcaatttacgtttcgcctccgcgttatagaaattattcagccaggcgttaaggtttgctgttgttggcggtgcagtttgtgcgggtatatcacccactaccggtgcgccacccgtcgccgcaacggttgccgctgcgttaccacccgtcgttgttacagtggtcgtcggttgaccggctggccacaaggagaaacttggtcccgccagggtaagtacgttcagccatagcagaatggcaaccacaaaaacggtaatgcgaatccattgtgacaggaataaccaggccacgaataaaacaaaaatggccccaatcatctgccagttaataaagcgtgtgacaagatcgattaaataatcggtactgaaccccgccacctgcgaaccctggctcattatgctttccgggccaggcaaccaggtgtcatgccagaacaaagcaaagccgatcggcagggcaatccagtggcgcaagcgatgcaggctgtagcgcggaatgggcatcagcagaaacgcggcaaacaccagattgaggagcggatggaagttaagatatcccgcccacaacaggccgaacttaaccagaaaatagaagttccagccggaaaggccgcgccagtattgccagagggaagaaggcatggcggtattttgcgtaaattgagtcattttttggttgccctggctttttccgtgcggcgtaacgtcccggccggtttaacataacgaggtttagcaaagaacaaacgtaaggtgtcgcgaatgcgtcgcaaagagtgccgcgccagatagcccagcgggaaaaatatcagtgcgcaaacgacaataatttcaatgatatcgctgatggtcatcatgatgagcgctccacagcatcatctaacagtcgcattggttctggtattcgtcgccagtggcgaccatcgtgctcggcattgatgaccggtttagaactttgcgctaaaggcagcggcatgccccattgttctggggcaagcaggcgcatctgcaccagctcggcactgatttgatcatcttcaaaccagaccattcggtttgagaaaatgtcgccagtaggcaatgggaaaatatgattcaacgcggtatccagatcgttaatccgacagaatgagagaaacagcaccagccgattaccgccaatggtcatgatatcgccggtacggttagggcgacatagcgtcagggcttgctcaacgcggatacccggtaccggacgtagggcaaccagaacgcctttaccgtgggcaggtaatagagggttattcatcatgttgttgacggcattacagaacacatcccacttctggaaaccacgcagtttgagcggctgggtcattgacagcaaggtagtgatatcttccggcacatagcgactaaacttctgcccttgcacgctttcgatcatcgtcagacagcgggagagtggcgcattccacgggataaccatatttgcaccgcaggccaataataaacgttcatcggtggcgcgcaggctggcggtattttcccgtacgaggattttcatcgcactaccgcgctggcgacgcagagtatgaatgctgcgggccagtggctcgatttgcgcattttgctgtaaagaaaagaccaccgtcgccgcctgagcggtacgggcttcattgaacaggacttcgttattgttgaacagttgccagtgttccgatagcggcggcgcaccttccagtacagcaacattactcagaatgcgtttttcgtcgctgcgtggttggatttccgcctcctggtgttgaactaatgtccagcaaccattttgttgctgaacgctaagctgctgacgggcgctgacccctttttcgttgcaccagaaagcaatatccagcaaatgttggtcgccctgaaaacgcaaactggcaagaccaaaaagtgaacggtattcctcaagtaacaatgaaaattgtttatcgttattatttccggaattaattaccaaaagcgaacaatggtttagccggctccatttattcattttatccaaccatgagcgaagccgctcggcaggaatgttttgccatgcgttatttgcgcaaacaagaataaaaaggtaattatggggatcaatagaacactgcaaatcacgggccaaatagtatagacctttttcatgatttagcattgaaaataatgttatttttcccggcccttgagaatcatctaattgaaagattttcgctggatcgctgtccatgctaatgaccgcgacgtgtgcggtttcagcctaggatgcaattgtttgattcgccagactgatagcatcttcatggcgatcgacgttaaaccaccagacgccgcctgctggcatatgtcgcagctcatcccataatgatgagataccgatagagaatacagggtccacaatgtccctcatgtcaacattttgtctgattatcagtttactagcgaaagctaagaaataaacctaccattgaaattaaaacttatcagatttagcatgtgaatcaatttagcaggtcacaagacatgtgattttagtcttttcgtttttaactttttctgttgcgtaacggaaagtcaaaaagtgagcacattcccgtctcgccgtaaacaataaaccgacgaaatgctcacagttagaattgtctcatgaacggtacggttatttcatagggatcaagaaaaatgaataacaatgaaccagatactctgcctgatcccgcgataggctatatcttccagaatgatattttggcgttaaagcaggcattttcactgcctgatattgattatgccgatatttcccaacgcgaacagttggccgcggcattaaaacgctggccgttgctggcagagtttgcgcaacaaaagtaggggattggtgaatggccgtactgggattgcagggggttcggggaggcgtggggacaacaaccatcaccgccgcattagcctggtcattacaaatgttgggagaaaatgtcctggtggtcgatgcctgcccggacaacttgttgcgcctgtcatttaacgttgattttacccaccgtcagggttgggccagagctatgctggatggccaggactggcgtgacgccgggttgcgctatacctcgcagctcgatttgctgccttttggtcagttatccattgaagaacaagaaaatccacagcactggcaaacccggctgagcgatatttgctccggcttacagcaactaaaagccagcgggcgttaccagtggattttaattgacttaccgcgtgatgcctcgcagataacccaccagctgctgagtttgtgcgagcactcgctggcaatcgtcaatgtggatgccaactgccatatccgattgcatcagcaagcgctgccggatggtgcacatattttgattaatgacttccgtattggcagccaggttcaggacgatatttaccagctttggttgcaaagccagcgccgattgctgccgatgctcgttcatcgtgatgaagcgatggctgaatgtctggcagctaagcaaccagtcggtgaatatcgcagtgatgcgctggcggctgaagagatactgacgctggcgaactggtgcctgttgaattattccgggctgaaaacgccagtcgggagtgcatcatgagtatcctgacccggtggttgcttatcccgccggtcaacgcacggcttattgggcgttatcgcgattatcgtcgtcacggtgcgtcggctttcagcgcgacgctcggctgtttctggatgatcctggcctggatttttattccgctggagcacccgcgctggcagcgtattcgcgcagaacataaaaacctgtatccgcatatcaacgcctcgcgtccgcgtccgctggacccggtccgttatcttattcaaacatgctggttactgatcggtgcatcgcgcaaagaaacgccgaaaccgcgcaggcgggcattttcaggtctacaaaatattcgtggacgttaccatcaatggatgaacgagctgcctgagcgcgttagccataaaacacagcatcttgatgagaaaaaagagctcggtcatttgagtgctggggcgcggcggttgatccttggtatcatcgtcaccttctcgctgattctggcgttaatctgcgttactcagccgtttaacccgctagcgcagtttatcttcctgatgctgctgtggggggtagcgctgatcgtacggcggatgccggggcgcttctcggcgctgatgctgattgtgctgtcgctgaccgtttcttgccgttatatctggtggcgttacacctcgacgttaaactgggacgatccggtcagcctggtgtgcgggcttattctactcttcgctgaaacgtacgcgtggattgtgctggtgctcggctatttccaggtcgtatggcctctgaatcgtcagccggtgccattgccgaaagatatgtcgctgtggccgtcggtggatatctttgtcccgacttacaacgaagatctcaacgtggtgaaaaataccatttacgcttcgctgggtatcgactggccgaaagacaagctgaacatctggatcctcgatgacggcggcagggaagagtttcgccagtttgcgcaaaacgtgggggtgaaatatatcgcccgtaccactcatgaacatgcgaaagcgggcaacatcaacaatgcgctgaaatatgccaaaggcgagttcgtgtcgatattcgactgcgaccacgtaccaacgcgatcgttcctgcaaatgaccatgggctggttcctgaaagagaaacagctggcgatgatgcagacaccgcaccacttcttctcgccggatccgtttgaacgcaacctggggcgtttccgtaaaacgccgaacgaaggcacgctgttctatggtctggtgcaggacggcaatgatatgtgggatgccactttcttctgcggctcatgtgcggtgattcgccgtaagccgctggatgagattggcggtattgctgtcgaaacggtaaccgaagatgcgcacacttctctgcgtctgcaccgtcgtggctacacctcagcgtatatgcgtattccgcaggcagcggggctggcgaccgaaagtctctcggcgcatatcggtcagcgtattcgctgggcgcgcgggatggtgcaaatcttccgtctcgataacccgctcaccggtaaagggctgaagtttgctcagcgactgtgctatgtcaacgccatgttccacttcttgtcgggcattccacggctgatcttcctgactgcgccgctggcgttcctgctgtttcatgcctacatcatctacgcgccagcgttgatgatcgccctgtttgtgctaccgcatatgatccatgccagcctgactaactcgaagatccagggcaaatatcgccactctttctggagtgaaatctacgaaacagtgctggcgtggtatatcgcaccaccgacgctggtggcgctgattaacccgcacaaaggcaaatttaacgtcaccgccaaaggtggactggtggaagaagagtacgtcgactgggtgatctcgcggccctacatcttccttgttctgctcaacctggtgggcgtagcggttgggatctggcgctacttctatggtccgccaaccgagatgctcaccgtggtcgtcagtatggtgtgggtattctacaacctgattattctcggcggcgcagtcgcagtatcggtagaaagcaaacaggtacgccgatcgcaccgcgtggagatgacgatgcccgcagcaattgcccgcgaagatggtcacctcttctcgtgtaccgttcaggatttctccgacggtggtttggggatcaagatcaacggtcaggcgcagattctggaagggcagaaagtgaatctgttgcttaaacgcggtcagcaggaatacgtcttcccggctcaggtggcgcgcgtgatgggtaatgaagttgggctgaaattaatgccgctcactacccagcaacatatcgattttgtgcagtgtacgtttgcccgtgcggatacatgggcgctctggcaggacagctacccggaagataagccgctggaaagtctgctggatattctgaagctcggcttccgtggctaccgccatctggcggaatttgcgccttcttcggtgaagggcatattccgtgtgctgacttctctggtttcctgggttgtatcgtttattccgcgccgcccggagcggagcgaaacggcacaaccatcggatcaggctttggctcaacaatgatgataacgcgatgaaaagaaaaatattctggatttgtgcagtggctctggggatgagtgcgttcccctctttcatgacgcaggcgacgccagcaacgcaaccactgatcaatgctgagccagctgtagccgcccaggcggagcaaaatccgcaggtggggcaagtgatgccgggcgtgcagggcgcagatgcgccagtcgtggcgcagaacggtccttcccgtgatgtgaagctgacctttgcgcaaattgcgccgccgccgggcagcatggtgctacgtggcattaacccgaacggcagcattgagtttggtatgcgcagcgatgaagtggtgacgaaggcgatgctcaacctcgaatacacgccatcgccatcattactgcctgtccagtcgcagttaaaggtttatctcaatgatgaactgatgggcgtgctgccagtgaccaaagaacagttgggtaaaaaaacgctggcacaaatgcccattaacccgctgtttattactgatttcaaccgtgtgcggctggagtttgtcggccattatcaggacgtgtgcgaaaacccggccagcaccacgctttggctggatgttgggcggagcagtggactggatctgacctatcagaccctgaatgtgaagaatgacctgtcacacttcccggtgccattctttgacccgcgtgataaccgcaccaacaccttgccgatggtctttgcgggtgcgccggatgttgagctgcaacaagcatctgccattgtcgcctcgtggtttggttcgcgttctggctggcgtgggcagaacttcccggtgctctataaccaactgccggatcgcaatgccattgtctttgccaccaatgacaaacgcccggacttcctgcgcgatcatccggcggtaaaagccccggtgattgagatgattaaccatccgcagaatccttacgtcaaactgctggtggtgtttggtcgtgacgacaaagacttgttgcaggcagcgaaaggtatcgctcagggtaacattctgttccgtggtgaaagtgtggtagtgaatgaagtgaaaccgctgctaccgcgtaaaccgtacgatgcgccgaactgggtgcgtaccgatcgtccggtcacctttggtgaactgaaaacctatgaagaacaattacaatccagcggtcttgagccagcagcgattaacgtttcgctaaacctgccgccggatctctacctgatgcgcagtaccggcattgatatggatattaattaccgctacaccatgccgccggtgaaagacagttcgcggatggatatcagcctgaataaccagttcctgcaatccttcaacctgagcagcaaacaggaggcgaaccgcctgctgctgcgtattccggtattacaaggtttgctggatggcaaaacggatgtctctattccggcgctgaaactgggcgcgaccaaccagttgcggttcgactttgagtatatgaacccgatgccgggcggttcggtggataactgtattaccttccagccggtgcagaatcatgtggtgattggtgacgactccaccatcgacttctcgaagtattaccacttcatcccgatgccggatctacgcgcctttgctaacgcgggcttcccgttcagccggatggcggatttgtcgcaaaccatcaccgtgatgccgaaaacgccaaacgaagcacagatggaaaccttgctgaataccgttggctttatcggtgcgcagacgggcttcccggcgattaacctgacggtgaccgatgatggcagcaccattcagggcaaagatgccgacatcatgatcgtcggtggtatcccggacaaactgaaagatgacaagcagatcgacctgttggtgcaggcgaccgaaagctgggtaaaaacgccgatgcgccagaccccgttccccggtattgtgccggacgagagcgatcgcgcggcagaaacccagtcaacgctgacctcttccggtgcgatggcggcggtgattggcttccagtcgccgtataacgaccagcgcagcgtgattgcgctgctggcagatagcccacgcggttatgaaatgcttaacgatgcggtgaacgatagcggcaaacgcgccaccatgttcggttcggtcgcggtgatccgcgagtccggtatcaacagcctacgtgttggcgatgtttattacgtaggtcatctgccgtggttcgagcgcttgtggtatgcgctggcaaaccatccgattctgctggcggtgctggcggctattagtgtgatattgctggcgtgggtactgtggcgtctgctgcgtattattagtcgtcgtcgtcttaacccggataacgagtaattgaagatgaatgtgttgcgtagtggactcgtgacgatgctgctgctggctgcctttagtgttcaggcagcctgtacctggcctgcctgggagcagtttaaaaaggattacatcagtcaggaagggcgcgtcatcgaccccagcgacgcgcgcaaaatcaccacctccgaagggcaaagttacggcatgttctttgccctggcggctaacgaccgtgcagctttcgataatcttctcgactggacgcagaacaatctcgctcagggttctttaaaagaacatttgcccgcctggctgtggggcaagaaagagaacagtaagtgggaagtgctggacagcaattcggcctccgatggtgatgtctggatggcctggtcgttgctggaggcggggcgtttgtggaaagagcagcgttataccgacatcggcagcgcattgctaaaacgtatcgcgcgggaggaagtggtgacggtgcctgggctgggctccatgttgttaccgggcaaagtgggttttgctgaggataacagctggcgttttaaccccagctacctgccgccgacgctggcgcagtatttcacccgctttggcgcgccgtggaccacgctgcgcgaaaccaatcaacgtttattgctggaaaccgccccgaaaggcttttcgccagactgggtgcgctatgagaaagacaaaggctggcagctaaaagccgaaaaaacattgatcagcagctacgacgctatccgcgtttacatgtgggtaggcatgatgcctgacagcgatccgcaaaaagcgcggatgctcaaccggtttaaaccgatggcgacattcactgagaaaaacggttatccgccggaaaaagtggatgtggctacggggaaagcgcagggtaaaggaccggtcggtttttctgccgccatgctgccctttttacaaaaccgcgatgcgcaggccgttcagcgccagcgcgtggccgataactttcccggcagcgatgcctattacaactatgtgctgaccctgtttggacaaggctgggatcaacaccgtttccgcttctcgacaaaaggtgagttattacctgactggggccaggaatgcgcaaattcacactaaacatattcacgctttccctcggtctggccgtcatgccgatggtcgaggcagcaccaaccgctcagcaacagttgctggagcaagttcggttaggcgaagcgacccatcgtgaagacctggtgcaacagtcgttgtatcggctggaacttattgatccgaataacccggatgtgattgctgcccgttttcgttctctgttacgtcagggcgatattgatggcgcacaaaaacagctcgatcggctgtcgcagttagcgccgagttcaaatgcgtataaatcgtcacggactacgatgctgctttccacgtcggatggtcgtcaggcactgcaacaggcaagattgcaggcgacgactggtcatgcggaagaagctgtggcgagttacaacaaactgttcaacggtgcgccgccggaaggtgacattgctgtcgagtactggagtacggtggcgaaaattccggcccgccgtggcgaagcgattaatcagctaaaacgcattaatgcggatacgccgggcaacacgggcctgcaaaataatctggcgctattgctgtttagtagcgatcgccgtgatgaaggttttgccgtcctggaacagatggcgaaatcgaacgccgggcgcgaaggggcctctaaaatctggtacgggcagattaaagacatgcccgtcagcgatgccagcgtgcaggcactgaaaaaatatctctcgatctttagcgatggcgatagcgtagctgctgcacaatcgcaactggcagaacagcaaaaacagctggccgaccctgctttccgcgctcgtgcgcaaggtttagcggcggtggactctggcatggcgggtaaagccattcccgaactacaacaggcggtgcgggcgaacccgaaagacagtgaggctctgggggcgctgggccaggcgtattcccagaaaggtgatcgcgccaatgcagtggcgaatctggaaaaagccctcgcgctggatccgcacaacagcaataacgacaaatggaacagtctgctgaaagtaaaccgctactggctggcgatccagcagggcgatgccgcgctgaaagccaataatcctgaccgggcagaacggctgttccagcaggcacgtaatgtcgataacaccgacagctatgcagtgcttgggctgggcgatgtggcgatggcgcgcaaagattatcccgccgccgaacgctattaccagcagaccttgcgtatggacagcggcaacactaacgccgtgcgcgggctggcgaatatttaccgccagcagtcgccagaaaaagccgaagcgtatatcgcctcgctctctgccagccagcggcgcagcattgatgatatcgaacgcagcctgcaaaacgaccgtctggcacagcaggcagaggcactggaaaaccaggggaaatgggcgcaggcggcagcacttcagcggcaacgactggcgctggaccccggcagtgtatggattacttaccgactttcgcaggatctctggcaagccggacaacgcagccaggccgatacgttaatgcgcaatctggcgcagcagaagccgaacgacccggagcaggtttacgcttacgggctgtacctctccggtcatgatcaggacagagcggcgctggcgcatatcaacagcctgccgcacgcgcagtggaacagcaatattcaggagctggttaatcgactgcaaaacgatcaggtgctggaaaccgctaatcgcctgcgagaaaacggtaaagaggcagaagcggaagcgatgctgcgccagcaaccgccttcctcgcgtattgatctgacgctggctgactgggcgcagcagcgacgtgattacaccgccgcccgcgctgcatatcagaatgttctgacgcgggagccaactaacgccgatgccattcttggtctgacggaagtggatattgctgccggtgacaaagcggcggcacgtagccagctggcgaaactgcctgccactgataacgcctcgctgaacacacagcggcgcgtggcgctggcacaggcgcagcttggcgataccgcagcggcgcagcagacatttaataagttgatcccgcaggcaaaatctcagccaccgtcgatggaaagcgcgatggtactgcgtgatggtgcgaagtttgaagcgcaggcgggcgatccaacgcaggcgctggaaacctacaaagacgccatggttgcatccggtgtgaccacgacgcgtccgcaggataacgacacctttacccggctgacccgtaacgacgataaagatgactggctgaaacgcggcgtgcgcagcgatgcggcggacctctatcgccagcaggatcttaacgtcactctcgagcacgattactggggttcgagcggtaccggtggttactccgatctgaaagcgcacaccactatgttgcaggtggacgcgccctattctgacgggcggatgttctttcgcagtgatttcgtcaatatgaacgtcggcagtttctccactaatgccgatggcaaatgggatgacaactggggcacctgtacattacaggactgtagcggcaaccgcagccagtcggattccggtgccagcgtggcggtcggctggcgaaatgacgtctggagctgggatatcggtaccacgccgatgggcttcaacgtggtggatgtggtcggcggcatcagttacagcgatgatatcgggccgctgggttacaccgttaacgcccaccgtcggcccatctccagttctttgctggcctttggtgggcaaaaagactctccgagcaataccgggaaaaaatggggcggcgtgcgtgccgacggcgtggggctaagtctgagttacgataaaggtgaagcaaacggcgtctgggcatcgcttagcggtgatcagttaaccggtaaaaatgtcgaagataactggcgtgtgcgctggatgacgggctattactataaggtcatcaaccagaacaatcgccgcgtcacaatcggcctgaacaacatgatctggcattatgacaaagacctgagtggctactcactcggacagggcggttactacagtccgcaggaatacctgtcgtttgccataccggtgatgtggcgggagcgcacggaaaactggtcgtgggagctgggggcgtctggctcgtggtcgcattcacgcaccaaaaccatgccgcgttatccgctgatgaatctgatcccgaccgactggcaggaagaagctgcgcggcaatccaacgatggcggcagcagtcagggctttggctacacggcgagggcattacttgaacgacgtgttacttccaactggtttgtcggcacggcaattgatatccagcaggcaaaagattacgcccccagccatttcctgctctacgtacgttattccgccgccggatggcagggtgacatggatttaccaccgcagccgctgataccttacgccgactggtaagttttcagatagcgcctctcttaatgccgctgcgatcgggtatactcgggcggcaatctgggatttccggggggagacaatttgcgcgtaagtcgctcgttaacaatcaagcagatggcaatggtggcagccgttgtcctggtgttcgtttttattttttgcaccgttttgctgttccatctggtccagcagaatcgctataacacggctacgcaactggaaagcattgctcgctctgtccgcgaacccttatcttctgccattttgaaaggcgatattcccgaagcggaagctattcttgccagcattaaaccggcaggcgtggtcagccgtgccgatgtagtgctgcctaaccagttccaggcgctgcgtaaaagttttattccagagcgtccggtgccggtaatggttactcgcctgtttgagctaccggtgcaaatctcgctgggcgtttactcgctggaacgtccggcaaacccgcagccaattgcctatctggtgttacaggcggattccttccgcatgtataagttcgtgatgagcaccctctcaacgttagtgaccatttacttacttttgtcgttaatattgacggtggcgattagctggtgcattaaccgcctgattttgcatccgttacgcaatattgctcgcgaacttaacgccatcccaccccaggagcttgttggtcaccaactggcattaccgcgtctgcatcaggacgatgaaatcggtatgttggtgcgcagttacaacctcaaccagcaattgctgcagcgccattatgaagaacagaacgaaaatgcgatgcgcttcccggtgtcggatttgccgaacaaagccttgctgatggagatgctggagcaggtggtggcgcgtaaacaaactaccgcgctgatgatcatcacctgtgaaaccctgcgtgatactgcgggtgtgctgaaagaggcgcaacgagaaattctgctgctgacgctggtggaaaaactcaaatcggtactgtcgccacgcatgatcctcgcgcagattagcggttatgactttgctgtcattgccaacggtgtacaggaaccgtggcacgctatcacattaggtcagcaagtgctcactatcattagcgagcgcctgccgattgaacgtattcaactccgtccgcactgtagcattggcgtggcgatgttctacggcgatctcaccgccgaacagctttacagtcgcgctatttctgcggcatttaccgctcgccataaaggcaaaaatcagattcagttctttgatccgcagcagatggaagccgcccagaagcggttgacggaagagagcgatatccttaatgcactggaaaatcatcagtttgcgatttggttacagccacaggtcgagatgaccagcggtaaactggtcagtgcggaagtgttactgcgtatccagcaaccggatggcagttgggacctgcccgatggcttaatcgatcgcattgagtgctgtgggctgatggttaccgtcggtcactgggtgctggaagagtcctgtcgattgcttgctgcctggcaagagcgcggcattatgctgcccttgtcggtaaacctctcagcgctgcaactgatgcatccaaatatggtggcggatatgctggaactgttaacccgctatcgcattcagccgggaacactgattctggaagtgacagaaagccgacgtattgacgatcctcatgctgcggtggcaatcctccgtccgctgcgcaatgccggagttcgggtggcgctggatgatttcggcatgggctacgcagggctgcgtcagctgcagcatatgaaatcgttgccaatcgacgtactgaaaatcgacaaaatgtttgttgaaggtttgccggaagatagcagcatgattgctgcaattatcatgctggcgcagagcctgaacctacaaatgattgccgaaggcgtggagactgaagcacaacgcgactggctggcaaaagcgggcgttggtattgcccagggcttcctttttgctcgcccactccctattgaaatcttcgaagagagttacctggaagaaaagtaactaccccaaactgattacaaaactttaaaaagtgctggtttgtgcgagccagctcaaactttttaacctttttgtttcaattatgatccaggtacatttctgtgatgttgtctgggtgttattttaaggccgcaggtaccccataaccttacaagacctgtggttttactaaaggacaccctatgaaaacctctctgtttaaaagcctttactttcaggtcctgacagcgatagccattggtattctccttggccatttctatcctgaaataggcgagcaaatgaaaccgcttggcgacggcttcgttaagctcattaagatgatcatcgctcctgtcatcttttgtaccgtcgtaacgggcattgcgggcatggaaagcatgaaggcggtcggtcgtaccggcgcagtcgcactgctttactttgaaattgtcagtaccatcgcgctgattattggtcttatcatcgttaacgtcgtgcagcctggtgccggaatgaacgtcgatccggcaacgcttgatgcgaaagcggtagcggtttacgccgatcaggcgaaagaccagggcattgtcgccttcattatggatgtcatcccggcgagcgtcattggcgcatttgccagcggtaacattctgcaggtactgctgtttgccgtactgtttggttttgcgctccaccgtctgggcagcaaaggccaactgatttttaacgtgatcgaaagtttctcgcaggtcattttcggcatcatcaatatgatcatgcgtctggcacctattggtgcgttcggggcaatggcgtttaccatcggtaaatacggcgtcggcacactggtgcaactggggcagctgattatctgcttctacatcacctgtatcctgtttgtggtgctggtactgggttcaatcgctaaagcgactggtttcagtatcttcaaatttatccgttacatccgtgaagaactgctgattgtactggggacttcatcttccgagtcggcgctgccgcgtatgctcgacaagatggagaaactcggctgccgcaaatcggtggtggggctggtcatcccgacaggctactcgtttaatcttgatggcacatcgatatacctgacaatggcggcggtgtttatcgcccaggccactaacagtcagatggatatcgtccaccaaatcacgctgttaatcgtgttgctgctttcttctaaaggggcggcaggggtaacgggtagtggttttatcgtgctggcggcgacgctctctgcggtgggccatttgccggtagcgggtctggcgctgatcctcggtatcgaccgctttatgtcagaagctcgtgcgctgactaacctggtcggtaacggcgtagcgaccattgtcgttgctaagtgggtgaaagaactggaccacaaaaaactggacgatgtgctgaataatcgtgcgccggatggcaaaacgcacgaattatcctcttaatctcaccacttatgcccgcactcccttccccgagtgcgggtgtttgcgcataattgacccctgtgcctgaacttaccacctgggtgagttcaggtttatttcacttcttccgtgacattttcatgttcttgcggtctaacacgaagtgtttttaacgtcatttagactgaccgacaacgggcagttttttattaccaggatagttgatcaggggttcacatgcagggcacaaaaattcgacttttagcgggcggtttgctgatgatggccactgctggctatgtgcaggcagatgcgctccagcctgatccagcatggcaacaggggacgctttccaacggtttacagtggcaagtgctgactacgccccaacgtcccagcgatcgtgttgaaattcgcctgctggttaataccggttcgctcgccgaaagtacacaacagagcggttacagtcacgccatccctcgtattgcgctaacgcaaagcggtggccttgacgcagcgcaggcgcgttcattgtggcagcaggggatcgaccctaaacgcccgatgccgccggtaattgtctcttatgacaccacgctgtttaatctgagtttgcccaataaccgtaacgacttgctgaaagaggcgctctcttatctggcaaatgccactggcaaactgactatcacgccagaaaccatcaaccatgcgttgcaaagtcaggacatggtggcaacctggcctgccgatactaaagagggctggtggcgttatcgtctgaaaggatcaaccttgttaggtcacgatcctgccgatccgctgaaacaacccgttgaagcggaaaagattaaagatttctatcagaaatggtacaccccggatgcaatgacgctgctggtggtgggaaacgtggatgcgcgctcggtcgtcgaccaaatcaataaaacgtttggcgaactgaaaggcaaacgtgaaacaccggctccggtgccgacgctttctccgctgcgtgcggaagcggtgagtattatgaccgacgcggtgcgtcaggaccggctatctatcatgtgggatacgccgtggcagccgattcgtgaatcagccgcactgctgcgctactggcgtgcggacctagcccgtgaggcgctgttctggcatgttcagcaagcgttaagcgccagtaacagtaaagacatcggtcttggatttgactgtcgtgtgctgtatctgcgtgcgcagtgtgccatcaacatcgaatcaccaaacgacaagctgaacagcaaccttaatctggtggcgcgtgaactggcgaaggttcgcgataaaggtctgccggaagaagagttcaatgcgttagtggcgcaaaagaaactggagctgcagaaactgtttgccgcctatgcgcgagctgataccgatattctgatggggcagcggatgcgttcgttgcaaaatcaggtcgtcgatatcgcgccggagcaatatcagaaactgcgtcaggatttccttaacagcctgacggtggagatgttaaatcaggatctgcgtcagcagttgtcgaatgatatggcgttaatactgctgcagccgaaaggcgagccggaatttaacatgaaagcgttgcaggcggcctgggatcaaatcatggccccatcgactgcggctgccgccacatctgtcgccacggatgacgtacatcctgaagtgacggatattccacctgtacagtaatgcctgatggtgatgagttagcacaaccatcaggtatttatggatgagctggataggggggtaacactctatccagccttttgcatatgctgcttttacgctggcatcgcttcacgcgggataatcgcgccgcgatactgaataacggtacttgcggtcaggtgcccgcgtttcgctgcgtcttccgcaattccgcccgtcaaacgtaccgccagataaccggcactgaaagagtcgccagctgcggtggtatcgatcactttttctttcggcagttttaccgccggaacatccactaacccttcgccagcaatggacaccaggcaagaatccgccccgcgtttcaccaccacttctttcacgcccgcgttatgggtgcgcgcaatgacgtcttccaccggctgttgaccccacagcgcgtcttcatcgtccagcgtcaggaaggcgatatccgtgcattccagcatttgttggtacacctgctgtgtctcttctttgctggcccacaggcgcggacgatagttattgtcgaaaatcacttttccgccgttggcgcggcattcgcgcagcagggaaagcagcttttcgcggctggtcgggcttaagatcgccaggctaatcccgctcaggtagagataatcgaaattcgccagctcttcgcaaatcgccgcggattgctcactctccagccagaatttggcggcggcttcgttacgccagtagtagaacgtacgttcgccggtgctgtcggtttcaatgtagtaaaggcccggcagacggttttccatccgttgggtcagggaagtatcaacgttctcgccgcgccaggcgtccagcatctgctggctaaaactgtccgttcccagcgccgttacgtaatgaacggttaatgccgcaggatcgacctgacgggcgatatagacggaagtgttcagggtatcgccgccgaaaccgcgcttaacgtccgcgcctttctcggaaagctcaatcatgcattcgccaatcacggcaatctttttggacatagtcgtgaacctgatctgtaaaaaattagcgttagtttgcgctgtggtggtttgctggtcaaccatattaaaacagtgttccattatttttttgagccagaacgtattcctgaaagattccgttgtggagtggggaaatttaccccggccaggcggtaaagttctgcccttgcgcgccgataatctttgtcgagtccgggcagcatcacttttaaacacaggacatctttgatgataaggcaggttatccagcgaataagcaaccctgaagcaagcatcgagagcttgcaggaacggcgtttttggttgcagtgtgagcgtgcttacacctggcagccgatctatcaaacatgcgggcggttaatggccgtggagctattaacggtggtcacgcatcccttgaacccttcgcaacgcctgccgccggatcgctattttactgaaatcaccgttagccatcggatggaggttgtgaaagagcagattgatttgctggcgcaaaaagccgacttctttgtagagcacggcctgctggcatcggtcaatattgatggccctacgctcatcgccctgcgtcagcaaccaaaaatcctgcgccagattgaggatcttccctggctgcgtttcgaactggtggaacacatccgcctgccgaaagattcaacctttgcctcgatgtgtgaatttggcccgctgtggctggatgattttggtaccgggatggcaaatttctctgcactaagtgaagtgcgttatgactacatcaaaatcgcgcgagaactgtttgtgatgctgcgtcagtcgccggaaggacgcacactcttttctcagcttttacatctaatgaatcgctattgtcgcggggtgattgtcgagggcgtagaaacaccggaagagtggcgtgatgttcagaactcgcccgcattcgccgcacaaggctggtttctttcacgcccggcaccgatagaaacgctgaatacggcggttctggcgctataagctgcctcattttccgcctggctggactatctttaggactggcacaggaagaatatgaggaagcgaacgatgagcaaggcaggcaaaataaccgctgcgatttcaggggctttcttgttgttgattgtcgtggcgatcattttgattgcaacttttgactggaatcgactcaaaccgaccatcaaccagaaagtctctgcggagttgaatcgtccgttcgctatccgtggcgatctgggcgtggtgtgggagcggcaaaaacaagaaactggctggcgcagctgggtgccgtggccccatgtacacgcggaagacatcattcttggcaatccaccggatattcccgaagtcacaatggtgcatttgccgcgagtagaagcgacgctggccccgctggcgctgctgaccaaaacggtctggttgccgtggatcaagctcgaaaagcccgacgcgcgcctgattcgcctctccgaaaagaacaataactggacgtttaatctcgccaacgatgacaacaaagacgcgaatgcaaagccgtcggcgtggtcgtttcagctggataatattcttttcgatcaagggcggatcgccattgatgataaagtaagcaaagcggatctggaaatttttgtcgatccgttaggcaagccgctgccgttcagcgaagttaccggatcgaaaggtaaagcggataaagaaaaggtgggcgattacgtttttggcctgaaggcgcagggacgttataacggtgaaccgctcactggtacgggaaaaataggcggtatgctggcgctgcgtggcgaaggaacgctgtttccggtacaggctgatttccgctctggtaacacccgtgttgcttttgatggcgttgtgaatgacccaatgaagatggggggtgtcgatttacggcttaaattttctggcgattcgctgggtgatctctatgaactgacgggcgttctgctgcccgatacaccgccgtttgaaacggatggtcggctggtagcgaaaatcgacactgaaaaatcgtcggtctttgattatcgcggttttaatgggcgcattggcgatagcgatatccacggttctctgatctataccaccggcaagccacgaccaaaactggaaggtgatgtcgagtcgcggcaattgcggctggcggacctgggaccgttgattggcgttgattccgggaaaggggcagaaaagtcgaaacggtctgaacagaagaagggcgaaaaaagcgttcagcctgcgggcaaagtgctgccttatgaccgcttcgaaaccgataaatgggacgttatggatgccgatgttcgcttcaaagggcggcgcattgagcatggcagcagcctgccgattagcgatctttctactcatatcatcctcaaaaatgctgacctgcgcctgcaaccgctgaaatttggcatagcgggcggcagcattgcggcgaatattcatctggaaggcgataaaaagccgatgcaggggcgggcagatattcaggctcgtcgactgaaactgaaagaactgatgcccgatgtagaactgatgcagaagacgctgggggaaatgaacggtgacgcggaactgcgcggtagcggtaactcggtggcggcgcttttaggcaacagtaacggcaacctgaaactgttgatgaatgacgggctggtgagccgcaacctgatggagattgttgggctgaatgtcggcaactacattgtcggtgcgatatttggtgatgatgaggtgcgggtgaactgcgcggcagcgaatctggatattgccaacggtgtggcgcgtccgcaggttttcgcttttgataccgagaatgcgttgatcaatgttaccggcacggcaagttttgcttcggaacagctggatttaactatcgatccagaaagtaaagggattcgcattatcacgctgcgttcgccgctgtatgtgcgtgggacgtttaaaaatccgcaggctggggtgaaagccgggccgttgattgcccgtggtgctgttgcggcggcactggcaacgctggttacgccagcggcagcattgctggcactgatctcaccttccgaaggggaggctaatcagtgccggacaattttgtcgcagatgaagaagtgatgataattgccggatgtctgacatccggcaattaaacagatttagattgttggcaaagtgtgctttgttcatgccggatgcggcgtgaacgcctccggcttacaaatccttgctaattcaatatattgtatggaaattctggcctgataagcgtagcgcatcaggcttttcactctgattacaacgactgatgtcgcgtctcatgggtcagcagcagggcgattaacgtcaagccagccatcgccgccagatatagccccaccgcacctaacccgtagttagtctgcaaccaggctgcgatatatggcgcaacggaagccccgagaatcgacgatacgttgtaagagaacgatgctccggtgtaacgcacttctgtcgggaacagctccggcagcagcgcccccatcggaccgaaggtcagccccatcagacttaaccccagcagcaggaaggcaaaaaccagaatcgggttgccagaaccgagcaaagggttaaaggcgaatagcgcgaacaggatgatcagcgtggtgatgattaccatgcttttacggcgaccaaaggcatcagccagtaatccggcgacgggcaccatcacgccaaaaccaataactgccatcatcagcatccacaacacttcgttacgcggcaggccaagcccaactggcgcggcggcggtactaaaggtcatagagtagaccgtcatgatgtaaaacagcgtataggttgccagcataatgaacgtacccagtacggttacgcgaacatgtttggtcagcagcgtacccagcgggatcttcacctgttttttcgctttagcgactttctcaaacaccggcgactcatgcagcgacacgcgaacatacaggccgataatgaccagcaccgccgagaagataaatggcacacgccagccccagctcataaactgctcgtcggtcagtagccaggaaagcagcaagaaagtgccgttggcaaagaagaagccaatcggtgcgcccagctgcgggaaggagccgtacaatgcacgtttgcgcggtggggcgttttcagtcgccagcagcgccgcgccgccccattcaccacctaagcccagaccctgaccaaatcgagccagcgccagcagcagcggggcgaaaataccaatcgtggcatagcctggcagcagaccaatcaccacggtcgaaatccccatcgttagcaacgaggcgaccagcgtcgctttacgcccaacgcgatcgccaaaatgaccaaaaacggcagagccaatggggcgcgcgacgaaggcgatggcgaaggtggcgagcgactgtagcgttgctgccgttggatcgccctgcgggaagaagatatgcggaaacacaataacggccgcagtggcgtaaatgtaaaagtcgaagaactcaatggccgtgccaatgagagaggcgacaaggactttattacgcgagttgatcggcgtgtattcttgctcgtggtcgagtgttgtggctgttgcttgcataatcttttcttattttttggctaacgaatagccatattacgcacagcaaaagtgatatttcaatgtgtaacaaatcgcggaaatggtcaaaaatcatgcaaaaaggggataatgtttaggccagtgatttttcttctatgaaatgcttcacataattttataaatggtggattaaactggttttaggttaaataaaagttaccaactggatttatatgctggggttatgagttggaatgaaattgtttgctcctgaatagatggctaaagaggctctgggaaagagtttcaagaggttatgtgcgcattatagccggatgcgatgctggcgcatcttatccggcctacggggagccaggccgaataaattcgtacgccgcatccggcctattttaaggctgcgttttccccggcattcgcgggtcgtctttatattcggcggtggcaatccacgccgcgcaaaacagcgtcaaacgggcgaagaagtagaaaaatgccatcagccccagcacggaaccaaatgctgcgccagagggtgatttcatcaacgatggcagggtgtaggtcatcacgattttaatcacttcaaaaccaatagcagccagaaatgttccgcggatcagggcttttttgcgcggacggtggcgcggcaaccgccagaagatccagaagaaaagcagatagttggcgaagatggaaatcgccaggccaatcaaccgccatgtcggtttcagccactcaatgctgttcaggtgcagggcgctaataatcatttgctgcgcagaaccggcaaccgaggtgatagaaagcgtcacaatcagcgcaatcaacaaaccaatcagcgaaataaaatcacgcagatattttacccagaacttctcctgatcttgcggcgagcgttcccagacatcgcgtgactgggcgcgaatcgcttcacgcaggttacccatccagttgatgccggaataaagcgccactgccagaccgacaagccctacagtcgtacgctgctgaacggcggtgttgatggtgtttttcaacgtggcggctagcgtcggatcgctaatgttttgcagaattttgtcgaagatatcctgtagcaacatcggatgggaggccagcacaaagccccctgcggcaaacgacaccatcaaaatggggatcatcgacaaaaatgagaaataggtgatagccgccccaaactggttacccagccgatcgttaaagcgttctgtcgcgcgaatcaggtgcgcaataaccggttggcgttggactttctcggcagtggtggtgacggtttccagcgcctggctaactttgccgcctttctcgctattatccaactgcttaatcggctcgtgctccagatcctgggtgggacgtttgatctcgttttcctgcgtcatccgctcttttgtccttctgtcgtggttattcttaaaaagtatagtcggtcagtccaggtgctctttcattacgccagccagccactgcataaacaggtttacacgccgggaaagctcccgacgctgcggataaaccagtgaaagggacagcggctcggcacggtagccaggcaacacttcaataagccgcccggcacgcagggcttcgcgcacggcaatgcgcgggatctgaataatccccagaccggcaataccggcggcgagatagttttcgctactgtttaccgtcaacatgccgccagacttaaaccactggacgccattaacgctggcaacctcaaaacctaacggatgtacacccaggtgcggtgtataacgcactattgcgtgtgaagtcagatcatcggggctttgcggataaccaaagcgcgtcagatagtgtggactggcacagttgaccatggtcagtttgccgagagaacgggcgataacgccatcttccggtaatgcgccagtgcgtatcacgcaatcaaaaccatcatgaagaatatctaccggacggtcatggctactcagttccagctcaattcccggatgcagatagagaaattccgacaagcgcggcagtaacaggcttttcgcgattcctggcgggatgtcgatgcgtaatttaccgctgatactggtggcatcctgttgaaacagaccgtccagttcgctgagattactcaacacatcttttgctcgttgataataggtcatgccttctggcgtgagtttgacccgtcgcgtggtgcgctggagaagctgggtgccaagttgatgttccagtgcctgtatctggcgcgaaacacttccctttggcaaagcaaagaaatccgccgcgcgggaaaaactttccagctccgcgactttgatgaacaactgcattgcgtgaattttatccatttctttgaccgattgttgttcacaacgaaacagtagcgcgcatatcgcattgtttattgttttttctaacatctaatgccgggtttcacaatgttgtcatgatgaatgtggcgatttctcagcaggaaaagggcggaatggctttatgagaaaggtgaattcccttaaacagagcgtatttttcagcgattccttttaaagtgaatagaagatgtattggctatttgtgcttatttttatctcattgccgtttgttatttttgtttatggtcgcggaatttcatttttaattgcatgcgtactaactaccgatataaggaaatcctcaaaaatgttttaaatagtgccctcgacatgtaatttcaggcgtttagctgtaactatttatatcggtaactattttctacgcgtcatctctgtagaatggccaccgccaaatggcgaattcttattttttctcgcgagtaatacccttccactacttaagtctttttaacgtattcaggtggagattcagttatgcaaatagtcatgtttgacaggcagtcaatatttattcatggaatgaaaatcagtttacagcatcgtattccaggagtgagtattcagggggccagtcaggcagacgagttatggcaaaagctggaaagttaccctgaagccttagtgatgctcgatggcgatcaggatggtgagttttgctactggttgctgcaaaaaaccgtggtgcaatttcctgaggttaaggtgttaattacggcgacggattgcaacaaacggtggttacaggaagttattcattttaatgtgctggccattgtgcctcgtgattcaaccgtcgagacatttgcgttggcggtaaatagtgcggcgatggggatgatgtttctgcctggagactggcgaacgacgccggaaaaggacattaaagatctcaaatcgttaagcgcccgccagcgggagattttaaccatgttagcggcgggcgaatcaaataaagagatcggcagggcgctgaatatcagtaccggaacggtaaaagcgcatctggaatcactgtatcgccgtctggaagtcaaaaatcgcacccaggcggcaatgatgttaaatatctcctcctgaagaggataattttacagccagcaggaagttagcggctggctgtaaaaatattatggttcgccgtacaaaccaattaaacggcgtaccacaccgttagtccagccaaacccatcctgcaacggatactcgccaccgccgccttcgcgaggaacaccatcggcaatatggtatttctcgatcagtttgtgctgttccagatagaactgattcaccgtcttcagccagttgcgcgcgatttcatcacccagaaggtcatcgccgtacatcttaaatccctgaattgccatccactgtaacggtgcccagccgttgggtttatcccactgttcaccggtttcgtactcgcttgccagaatcccgccaggtgtcagtaaccggctgcgcacggcgtttgccagacgatcggcctgttcatggttcgccataccgacatagagcggcacaatggcggcagcggaaaacagcgccagttgctcgcgtcgccagtcgtaatcgcggtagatgccgttttcatcatcccagaggtaacggtttaccgcatcgcgacgggcactggccttctggcggaacagtgcttctgtctctttctcgcctttcagcgccgagatgttggcgatggcgctctccagtttaaacaggaaggcattcagatcgatggggatgaactgggtggtacgaatgctcgccagacgaccagtatcacgcagccaacgggaagagtaatcccaaccggaggccgcccccgcacgtaaatcgcggtacacctcgttaggcgggcgaccagaatgtttcgcggtttcaacgtcctcaagccaggattcgtcacgcggcgtgtcgcgatcgtcccagtaacgattgagcagcgagccgtccggcatccgcacaacatggcgataggcctgattagggatcaacgattctgcaccgtccatccagaaggcatattccattttcaggtggtcgagatagcggcgcgcgccgcgtacaccatcttcttcaaacaactccaccatcagcgcaaaaaccggtggttgcgagcggctcaaataataggtgcggttgccgttggggatgtggccgtagttttcgatcatccaggcgaagttatcggccatgcatttcagcaaatcttcccgaccactttccgccagccccagcatggtgaaataggaatcccaatagtaggtttcgctaaaacggccgcccgggacaatatatgactgcggcagcgccagcagagaagaccacggaatgtgatcctgtggttcacgggttagcaccggccacagctggtcgatatgctctttcagggaattttgcgggtccgatacatactcgctggagtagacctccggcagccagaagtggttttcaacaaacttgcgcaagtcaaaatcacgatgacggcgcactttacggtagcggattaaaatatccagcgggtccattttgggtgcgcagtcgggaaaggttttactgtcggggaaaattttcgccgactgaacatgctcgaacagttcgagatagcgatcggcaggcgtcagcgcatcagaggcgggcagcccttcaatcatctcgggttccggttctgcctcgatcatctcatccagttttaattcatacgggtccagctcatagcagagatcgacctcgatcatcagttcgtctggattagggttttgaattttctgattgagcataaggatccgacctccgaaattcgtcgctaattatcgggcttttctttaagggtagtcattcgctccgcctggtgggcgacaaagcgtgcggtggatcacgtttattaacctgccaaaaaatataacgcactaatatcaatggaatttataaaaatacggatttcgtgttgtttttcattttcagaacattcaatcctgctctcgccgcaatcatgatatgccattcctgatctgggtaataggcactggctatcttattgatagtttatattcatgtaattgattgattcctatcaaaaagcatatctccctgttttttatgatggctttgtctcgcagagacgtttgcagcattctggaaaattttctgggtcacaataactcaccaccgtgagggaagaataatgaaaatggtctcacgtattaccgcgatcggcctggctggcgtcgcgatttgctatttagggttatctggttatgtgtggtaccacgataataaacgcagtaaacaggccgatgttcaggcatctgctgtcagtgaaaataataaggttttaggctttctccgcgaaaaaggatgcgattattgccatacgccttcggcagaattacctgcctattattatattcccggcgcgaaacagttgatggattacgacataaagcttggatataaatcttttaacctcgaggccgtgcgtgcggctctgctggctaataaacccgtttcgcaaagcgatctgaataagattgaatgggtgatgcagtatgaaactatgccgccaacgcgttataccgcgctacactgggcgggtaaggtgagtgatgaagagcgggcggaaatactggcctggattgcaaaacagcgcgcggaatattacgccagcaatgatactgctccggagcatcgcaatgaaccggtgcagcccatcccgcaaaaactgcctaccgatgcgcaaaaagtggcgttgggctttgcgctgtatcacgatcctcgtttatcggctgatagcaccatttcatgcgctcattgccatgcgttgaatgcgggaggcgtcgatggtagaaaaacatcgattggtgttggtggcgcagttgggccgattaacgcgccgacggtatttaactcagtatttaacgttgagcagttctgggatggtcgtgcggcaacattgcaggatcaggctggtggaccgccgttgaacccgattgaaatggcgtcgaaatcctgggacgaaattattgctaagctggaaaaagatccgcagcttaaagcgcagttcctcgaagtctatccgcaaggtttcagtggcgaaaatattactgatgccattgctgaatttgagaaaacattaattacgccggattccccatttgataaatggttgcgtggagatgagaatgctctgacggcgcaacagaaaaaaggctatcaattatttaaagataataaatgtgcaacttgtcatggtggtattattctcggcggacgttcctttgaaccgttggggctgaaaaaagactttaactttggtgaaattacggcggcggatattggtcgtatgaatgttactaaagaagagcgtgataaattgcgtcagaaagtacccggtttacgtaacgttgctttaacggcaccgtacttccatcgcggtgacgtgccgacgctggacggggcggtgaaactgatgctgcgctatcaggtaggcaaagagctgccgcaggaggatgtggatgatatcgtcgctttcctgcacagtctgaacggggtttacacgccgtatatgcaggataaacaataattaatttgatcgcccgaacaggagtgtttgggcgatttttattacgataataaagtctgtttttaatattatcatattaaatgtttatattataaaaggtcgtttttctgcttaggattttgttatttaaattaagcctgtaatgccttgcttccattgcggataaatcctacttttttattgccttcaaataaatttaaggagttcgaaatggaccagaagctgttaacggatttccgctcagaactactcgattcacgttttggtgcaaaggccatttctactatcgcggagtcaaaacgatttccgctgcacgaaatgcgcgatgatgttgcatttcagattatcaatgatgaattatatcttgatggcaacgctcgtcagaacctggccatgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcgcgacctttggtcagagaacgcagctgagttgcatatccgaacatttcagacagcggtacttcagcgtggatcttaacgccagtaacttcagattcctgacctttgagcataccacgacgacggctcaagtcaccgataacgtcaccggtgttctcttcaggagtttctacttcaaccttcatgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgattgcagctgcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtacacacggaagaaggtcaggttaccaacaaacgggtcggtagcgattttgaacgccagtgcagagaacggctcgtcatcacttgcgtgacgctcagccggagtgtctttaccgtcgtccaggataccgttgatcgcaggtacgtcaaccggggatggcaggtaatcaattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatacgcggaactttatatttgtttgcctgacgccatacggtctcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggattaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccaccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggagtgcttaaccgtaagtctgacgaaatcagtatagtcaatggaaatgatgtcgttcgaaattcgaccagtcaaaccgcgggcaataaggtcttcgttcagagcatagaccttaatgggggcattacgcagactttcaaggtagcggttgccgtcaactgcggcagttacgccatcttgcaataatagcagttcgtcaccttcactgagcagacgcagcagcgcagcaaaatccgtcagccagggtgaacgatgtaatgtgtgcagcataaatgcctcaaaacctcaaaataacatcgtagttggcgagttcgcggcgtaaggcatctgcttcgagcggcgtggcttcgacaacaaaaggtgtctgcggatctaacccgcgttcgcgcagtgaagccgcacaaacccagcactgttcaatgtcatacagacccaacaatttaaaagtggcaatgtaatcacgcgccagcactgcatcgggcttttgtcctggcagcagctgaaaaacgccatcagcaataaagaagacggccagatcgtcagttaatgcggaagttgcgagtaaagcatctaatccctcgcggccagccgcggtgccatgaggcacagtagaaaaaacaaacgcaattcgtttcatcagaactgtaccaccctgtcacaggtcagcgaggcttccgccagcgcgccaagtccgcttaaggtaaatcccgtctgaaggtttgacgaagccagccccagtcttccggcttccgtttcatcaacaacgccacggcgtaatgccgccgctacgcagatattcagcgccacaccatgttgcatattcaactgttgccagctgcgcacaaggtcaaattcgtcgcttgccggtgaggtcaattggttagcgttatagaccccttcccgatagaaaaaaacgctgcttaactcatggccttctgctattagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcgtctttaatatcgaagatccctttctcgtagagatttagcacgatctgacgatttttggcgttattagaaacattgcgatcggcattcacttcttcgatggtaaactccagcgtttgggtaaccagatcttcaacagaagaggcaaagttgacgcttgaaccgacatccggagtttccggcggcacaaaagtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcaaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttagtgcttattttttagcagagtctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagagagcggttcaccacgggtgtaagagttgtcgaactctttaccgtcgatcagcgtacctttgtagttcactacaacagtatcgctgtctttcggggcttcgcctttaccggcttctactacctgataaaccagaccagtggaagaggttttcacacctttctctttggcaaatttctcgcggtactctttaccttttgcttcgttatcagccgcgtctttttccatcttcgcctgagcagaagacttcacgcgagcttcgaatgcttgcagagtctgttcgatctcttggtcggaaagtttgctcttatcagcaaatgcatcctgaacaccagcgatcagctgatctttatccagtttgatgcccagtttttcttgttctttaagagagttttccatgtaacgacccagcgaagcacccagtgcataagctgatttctgatcgtcatttttgaacgctgctttgctgtcagcagttgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgcctccgccacattattgaggcgtaaaaaaagcggggattccccgcttttttgtcaccttttcgatattagtggcaaccgcaaccgccgttgcctttaccgccacagcagccttcgccaccgtgttcatgaccgtgatcgtggccatgaccaccgcagcaaccgtcgtggtcgtgatcgtggtggtgatcgtgcgcgccgtgaacgtgaccatgagccagttcttcttcggtcgcttcgcgaatcgccacaacttcaacgttgaatttcaggttctgaccagccagcatgtggttaccatcaaccactacgtgatcgtcttcaaccgcagtgatttcaaccggtaccggaccctggtcggtttcagccaggaaacgcatacctacctgcagttcatcaacgcccataaatacgtctttaggaacgcgctgcaccaggttttcgtcgtactgaccgtaagcgtcgttcgcgccaacagcgacatcaaatttgtcgccaacttcatgaccttccagcgctgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccaatcacttgctcatctttgcggacgtgatcgcgggcttctttgtctgcttctcgcatctgatgtccacacttaacacattcaacgatatcaatattattttcgcgccacatcgccattgaatcctgtgcctgacaggccgggcattttgcgcccgcaataaaacgttttcggattgccatctttaccctctactcaaattcatcccagccgtccagctggcgtcgttcttgttgcatttcacgctggaaaatctcttccagttcacgtcgggcttccctggcgcgagaaatttgtacggtatcagcatgcatcgggattaactcccgcagcattcgcatatccaggcggcgaaaatgcagttgcgcgcgctgcgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgctggcatatttccaccagcttcatagtgtcttccggctcgttacaggtaatgacgatagactcagcggcctctgcacccgcagaacgtaaaagatctacctgcgtggcgtcgccgtaataaactttgtagccatatttgcgcatcaggttaacggcactgatatcccgctccagtacagtaatgcgcattttatttgccatcagcaaacgaccaatcacctgaccaaaacgcccaaagcccacgacaatgacctgcggtttatcatcgttgacccatggtttttcgtcttcttcttccggtccgttaaactggcgggatagccatttatcgaccagcttcatcagcagcggcgtggtcatcatggaaagcgtcaccgtcaccagcaacagcgccatctggtcgccctagaataagcgttgtgaagaagcggtagaaaagaggacaaaggcaaactcaccgccctgactcaacacgccagcaaactgcatccgctcagaactgcgcacgccatacaatcgcgccagcagatacagcacgagaattttcaccgccaccagcacaaccacacttatcactacccacaacagatgggtataaagcaccccgaggttgagcgacatgccgacagagataaagaacaaaccaagcagcaagcctttgaagggatcgatagccgtttccagttcatggcgatattcactttccgccagtagcacacccgcaataaacgtaccgagcgccatcgacaaccccagcgcatccataaacaatgcggaacccaacaccagcagcagcgtcgcggcggtgaacacttcccgcacaccagaagctgcaataaaacggaataccggacgcagtaaatagcgcccgccaatcagcatgccgacaaacgccagcaccttcatgccgatcttcatccagtcgaaatgttcgtctgccgaacccgccaacaacggcactaacgccagtgccgggatcaccgccagatcctgaaacagcagtaccgagaaacctaactggccggattcgctgcgattcatccctttctcacgcatcaattgcaacgccattgcagttgaagacatcgcaaggccaatgccaccgaccaccgccgcctgccatgagaaatgggtcagcatcaataatcctgccagcaacgccgcgcttaacagcacctgtgccgcgcctacgccaaaaatcgaacgccgcagttgccaaagcttggagggattcaactcaaggccgatgataaacatcaggaataccacgccgagttccgaaaagtggaggatctcatcgacgtcgctaataaaccccagcccccacgggccaatcgcaatccccgccagcaaatatcccaacactgcaccaatacccagccgcgatgccagcggcaccgcagccaccgccgcgaagagaaacagcactcctgcgagtaaaaaatcagaaccttccatcagcagcctcctggagacagcggatttgccagccagtcaccgtaggctctggcgtggctcgccagctcctgtgcgctttgccgtctcgcccagtaaataatgatggggcttaaccaatgcatccggcacatgcccgccgccagttcaaaggggcgcagaacatcgctcatcgggtagcgattcaacgcgtcataacggtaagcactttccggctccccggtggtaatcacgctacgccagtactttcccgccagttggtttccccccggtccgctggcaaaaccacggcttaatacccggtccagccactctttcagtagcgccgggcagctataggtataaagaggatgctgaaagacaatcacctcgtgctcgcgcagtaatgcctgctcacgagggatatcaataaaaaagtcgggatagtgcgcgtaaaggtcgtgcacggtaacattgctgagctgcgtggccggtttaagcagaacccagtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcgccttatgattgttttttcctcgttacaaattcgtcgcggcgtgcgcgtcctgctggataatgccaccgccaccatcaaccctgggcagaaagtcggcctggtgggtaaaaacggctgtggtaaatctaccctgctggcattgctgaaaaatgaaatcagcgccgacggcggcagctacacctttccgggaagctggcaactggcgtgggtgaatcaggaaacaccggcgttaccgcaagcggcgctggaatatgtcattgacggcgaccgtgaatatcgtcaactggaagcgcagctacacgacgccaacgaacgtaacgacgggcacgccattgcgaccattcatggcaagctggatgctattgacgcatggagtattcgctcccgtgccgccagcctgctgcacggcctcggtttcagcaatgaacaactggagcgcccggtaagtgatttctccggtggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgaccgcgacttcctcgatccgatcgttgataaaattattcatatcgaacaacaaagcatgttcgagtacaccggcaactacagttcgtttgaagtacagcgcgccacccgtctggcgcagcaacaagcgatgtatgaaagccagcaggaacgcgtagcgcatctgcaaagttatatcgaccgtttccgtgccaaagccaccaaagcgaagcaggcccagagccgcattaagatgcttgagcgtatggagctgattgcccccgcgcacgtcgacaacccgttccgctttagcttccgcgcgccggaaagcctgccaaatccgttactgaagatggaaaaagtcagcgcaggctatggcgatcgcattattctcgactcgattaaactgaatctggtccccggctcgcgcattggtctgctaggccgcaacggcgcgggtaaatcgacattaatcaaactgttagccggggaacttgcgccagtcagcggtgaaattggtctggcgaaagggatcaagctcggctacttcgcccagcatcaactggaatacctgcgcgccgacgaatcgcctattcaacatctggcacgtttagcgccgcaggagctggagcaaaaactgcgtgactacctcggcggctttggtttccagggcgataaagtaaccgaagaaacgcgccgcttctccggtggggaaaaagcccgcctggtgctggcattaattgtctggcagcgtccgaatctgctgctgctcgacgaaccgaccaaccaccttgacctcgacatgcgtcaggcactcaccgaagcattaatcgagttcgaaggcgcgctggttgtcgtctcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaacgcgaacagcgcccaggcacgtaaagatcagaagcgtcgggaagcggagctgcgtgcgcaaacccagccactgcgtaaagagattgcccgtctggaaaaagagatggagaagctgaacgcgcaactggcgcaggcggaagagaaactcggcgacagcgaactgtacgatcaaagccgtaaagcggagttgaccgcctgcctgcaacagcaagccagcgccaaatccggcctggaagagtgcgaaatggcatggctggaagcccaggagcagcttgagcagatgctgctggaaggccaaagcaactgatggcgcagataacaacgaccgatgccaatgaatttagcagcagtgctgaattcacccccatgcgcggctttagcaattgtcatctacaaaccatgctgccgcgtctgttccgtcgcaaggtgaaattcaccccgtactggcagcggctggagttgcccgacggcgattttgtcgatctcgcgtggagtgaagatcctgcacaggcgcggcataaaccgcgtttagtggtatttcacgggctggaaggcagtctcaatagcccttacgctcacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgagtttggtcatgcgccaacggctgccgtcggctattcgctcggcggtaatatgctggcctgtttgctggcaaaagaaggcaatgatctcccgattgatgcggcagtgattgtctctgcgccgtttatgctggaggcctgtagttaccatatggaaaagggcttttcccgcgtttatcagcgttacttgctgaacctgttaaaagccaatgccgcgcgcaagctggcagcctaccccggcacactgccgattaatctcgcgcagttaaaatcggtacgtcgcatccgtgaatttgacgatctcatcaccgccagaattcacggctacgctgacgctatcgactattatcgtcagtgtagcgccatgccgatgctcaatcggatagccaaaccgacactgattattcacgccaaagacgatccgtttatggatcatcaggtgatcccgaaaccggaaagtctccccccgcaggtggagtatcagctgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtcgccgacgtcaaacgccagctacagtgcggagaagcggtgctggtatggtcggagctgcacgaaacggtcaatatcatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagccgaggtggaaggcgacagttttcaccgttacacccgcccggaaatggacatggcgatccgcaaagcgcgcgacgccgggcggcatatcagctacttcggccccgaagcgaacgacttcggcctgctggaacaaaccttcattgaatacggtcagagcggcaaagggaaatctcgcaaatatctgcatacctacgacgaagccgtaccgtggaatcaggtaccggggacattcaccccatggcaacctttaccggaacccactgatgtactgttttatgaaggtttacacggcggcgtcgtcacgccacagcataacgttgcgcagcatgtggatttactggtcggcgtggtgcctatcgttaaccttgagtggattcaaaaactgatccgcgacaccagcgagcgcgggcactcacgagaagcagtgatggactcagtagtgcgctcaatggaagactatatcaactacatcacaccgcagttttcccgcacccatcttaacttccagcgcgttcccaccgtcgacacctcaaacccgttcgcggcaaaaggtatcccgtcgctggatgaaagctttgtggtgatccattttcgtaatctggaagggatcgatttcccctggctgctggcgatgttgcaaggctcattcatttcccacatcaatacgttagtggtgcctggcggcaaaatgggtctggcaatggaattaattatgctgccgctggtgcaacgattgatggaaggaaagaaaatcgagtaacgctgctattacgccggataaaatactatccggcttcacaacgggatagttaaatcacgcggcaaccacttcatacgagtgagtaatattcaccgctttttccagcatcagcgccactgaacaatatttctcggcagagagatcaaccgcacgcgcaaccgctgcgtctttcaggtcgcgaccggtgacgataaaatgcagattaatgtgcgtaaacaggcgtggtgcctcttcgcggcgctcagaggtcaattttacttcacaatcgaccacatcctgacgccctttttgcaggatagaaaccacatcgatggcactgcaaccacccgccgccatcaacaccatttccatcgggcttggtgctttatcgcctgagttgccgtccattaaaatctggtgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatatattgatgtactgcatgtatgcaaaggacgccacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtctgtctgcacagatggcgcgtcgtctgcaagtcacttcagagaaagtgggcaacctggcgttcctcgacgtgacgggccgcattgcacagactctgctgaatctggcaaaacaaccggatgctatgactcacccggacggtatgcaaatcaaaattacccgtcaggaaatcggtcagattgtcggctgttctcgtgaaaccgtgggacgcattctgaagatgctggaagatcagaacctgatctccgcacacggtaaaaccatcgtcgtttacggcactcgttaatcccgtcagagtggcgcgttacctggtagcgcgccattttgtttcccccgatgtggcgcagactgatttatcaccccgatatcaactatgcacttcgacaaacgctggtgctatgtttgcccgtggccgttgggttaatgcttggcgaattacgattcggcctgctcttctccctcgttcctgcctgttgcaatattgcgggccttgatacgcctcataaacgttttttcaaacgcttaatcattggtgcgtcgctgtttgccacctgtagcttgctgacacaggtgctactggcaaaagatgttcccctgccctttttgctgaccggattaacgctggtacttggcgtcactgctgaactggggccattgcacgcaaaattgcttcccgcatcgctgctcgctgccatttttaccctcagtctggcgggatacatgccggtctgggaaccgttgctcatctatgcgctgggcactttgtggtacggattgtttaactggttttggttctggatctggcgcgaacaaccgctacgcgagtcactaagtctgctgtaccgtgaactggcagattactgtgaagccaaatacagcctgcttacccagcacaccgaccctgaaaaagcgctgccgccgctgctggtgcgccagcaaaaagcggtcgatttaattacccagtgctatcagcaaatgcatatgctttccgcgcaaaataataccgattacaagcggatgctgcgtattttccaggaggcgctggatttgcaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccaacacccggataatccggttgggcaattctgctactggcatttcagccgcatcgctcgtgtgctgcgcacccaaaaaccgctctatgcccgtgacttactggccgataaacagcggcgaatgccattacttccggcgctgaaaagttatctgtcactaaagtctccagcgctacgcaatgccggacgactcagtgtgatgttaagcgttgccagcctgatgggcaccgcgctgcatctgccgaagtcgtactggatcctgatgacagtattgctggtgacgcaaaatggctatggcgcaacccgtctgaggattgtaaatcgctccgtgggaaccgtggtcgggttaatcattgcaggcgtgacgctacactttaaaattcccgaaggttacaccctgaccttgatgctgattaccaccctcgccagctacctgatattgcgcaaaaactacggctgggcgacggtcggttttactattaccgcagtgtataccctgcaactgttgtggctgaacggtgagcagtacatccttccgcgtcttatcgataccattattggttgtttaattgctttcggcggtactgtctggctgtggccgcagtggcagagcggattattgcgtaagaacgcccatgacgctttagaagcctatcaggacgcgattcgcttgattctgagcgaggacccgcaacctacgccactggcctggcagcgaatgcgggtgaatcaggcgcataacactctgtataactcattgaatcaggcgatgcaggaaccggcgtttaacagccattatctggcagatatgaaactgtgggtaacgcacagccagtttattgttgagcatattaatgccatgaccacgctggcgcgggaacaccgggcattgccaccggaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacaacgggttattggtcatctgaacaccatgcacaccatttcgtcgatggcatggcggcagcgaccgcatcacgggatttggctgagtcgcaagttgcgggattcgaaggcgtaatacaggctaaaccatcggatgaggtgttcacgccgcatccgacatcttttgcctgatgcgacgctgacgcgtcttatttacgccccaatcaccttcgccaccgcgtgggcgaaacgatgcatcccttcatcaatatccgcatcttccaccaccagcgacggcgcaaaacgcatcacatcaggcccggcattcagcaccattacgccttcctctgcacccgcatacaggaaatcacgcgcccgacctttgtactgtggtttcagctctgcgccaatcaacagccccataccgcgaatatcgctaaacacatcgtactgctgatcgatcttctgcaaatggtcaacaaaacgctggcgtttcgcctgaataccttccagcacttcaggggtattgatgatatcaaacgctgcgcccgctactgcacaggccagaggattaccgccgtaggtggaaccgtgagaaccaggatgaaacgcggaagcaatctccgccgtggtcagcatggcgctaaccgggaaaccgccacctaacgctttcgcagaggtcagaatatccggcgtcacgcagtagtgcatataagcaaacagatcgccggtccgccccatcccggactgcacttcatcaaacaccaataatgcctgatgctgatcacacagctcgcgcaagccctgcaaaaactctggcgtcgctgccgtcacgccgccctcgccctgaatcggctcaaccaccaccgcacaggtatggtcatccatcacggcttttactgcgtgaagatcgttaaaaggcacgtggatgatgtctgccggttttggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacggccaagacgcagcgccggctcattggtgaaaacgttactaatatgccacagagtttcgccctgggtttttaacgcgttcaccagcgcaggatggcaatggcccaacgccgtaactgcaatgccacccgcgaaatcgacatactccttgccctgttgatcccagattcggctgccctgaccttttaccggaataaactctgccggagcataaatcggcagaatcacttcatcgaaagtcgcgcgtgtaattgctgtttgttcaattgccatctcatgatcaccctgttacgcataaataaatatgaaattataatcacaaaatatgcataaaaaatcactgaatggcaatcagaaatcagcgatgcagaaaattagccagcagttgatgtccttgttcgctaagaatactttctggatggaattgcacaccttccagatcccactggcgatggcgaatccccataatctcgcgggtttcgctccaggccgtcacttcaaagcactccggtaatgagtcaggttccaccaccagcgaatggtagcgtgtcacggtgagtggatttgccagccccttaaatacgcccacaccattatgtgtaatcggcgaggttttgccgtgcatgacctttgcggcgcgcacaactttgccgccaaatgcctgcgccattgcctggtgaccgaggcagacgccaagaatcggcaagcgtccggcatagtgacgaataacgtcaagggagatcccggcttcatctggcgtacaggggccgggtgagatgacaattttttgtggtttaagggcgtcgatatccgccaacgtcaacgcatcgttgcgcttaaccaacacatccgcccccagttcacaaaagtactggtagaggttccaggtaaaagaatcgtagttatcaataagcaggatcatggcggctccggtacgaaagaaccgcgctattttactcagattccccggcttcgcttaccactttactaaatatcatctgcagcgcggtgagatcccccattgccccattctgatttgcctgattccaggcctctttttcgataccctgccagctcagttgatatccggcatgaatcgccagttgctcgaagaagatccgctgtgccaaaccacttcccacccggaagggatgcagcacgttgatttcacaatagtaatgcgccagccgctcgacgaacttcgctttctccaggccaaccagataaccttcttcctccagatcctgcatcagggcattgccctctttttcgatataagcaaagtggcagaacggcgtatcgccctgataaatatcaacttcacgcagttgccctgcccagtcgaaaatatcctgatacaactggcgatgaagagtaagcaaatgcggtaaaccccgaaccaacgggccaagttcaatggtcgcagcacgtagcgctgtcatttcgtaagcgacctgttccagccgctgctgctggcggatgttgagcttattacgcatgatatcgagaccagggtagagatatgggtcacgcccttcgccgaatttatcgctcatagtgcctcctcagcgcttcaaggcgcgctaaagcctctgcggcagtaagagtgactaaaggcatctcgacgccttcaagacggcgactggcctggaaattacgattacgctgaagctcccagagacgggacttttgcttatcggtgagtttcttcacttgatgcctccctgaacgtgtccatttgccacaagtataagcggcaaatccgggttacgccgggagagcagaagcgcgggcaagattgcccgcgcgagaaatcattacggcaggactttagcggaaaggataactaccggttttgacggcacattctggtacggaccaacgtcatgagtcggcacctgggaaatcttatcggcaacgtccatgcctttcaccactttaccaaataccgcgtaaccgaaatcacgctgaccgtggtcaaggaaggcgttatcggcaacgttgataaagaactggctggtggcgctgtctttgtcagcggtacgcgccatcgcgatggtgccacgcgtgttgcgcaggccgttatctgcttcatttttgattggcgggtttggttttttctgctgcatctgctcggtgaaaccgccgccctgaatcataaagccaggaatgacgcggtgaaaggtcgtgttgttataaaaaccactgttcacataatcgacaaagttttgcacagacactggcgctttttgtttatccagctccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgaggataactttttattccgtgatcaaaatcacctcttaaaatgcaatttagcaaccgattgcaataaaacatttaatcagatcacaaaatcgcctaaaatcgcccgctcgcggcatagcccgctatgccattttatttttgaacgcaggccaatcatgactaacagcaatcgcatcaagctcacatggattagctttctttcctacgcactgaccggtgcgttggttattgtcaccgggatggtgatgggaaatatcgccgattatttcaatctgcctgtttccagcatgagtaacaccttcaccttcctcaatgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctggtaacacaaatgtatgaaggacgtcagcgcggttcacgcctgttatttaccgactccttcttcagtatggccgggatgattttcccaatgatcgccgcgtttctgctggcacgtagcattgagtggtactgggtttatgcctgcatcgggctggtgtatgttgctatttttattctgaccttcggctgtgaattcccggcactgggcaaacatgcgccaaaaacagatgctccggtagagaaagaaaagtgggggatcggcgtactgtttctctctgttgcggcgctgtgctacatcctcggtcagttaggttttatctcctgggtgccagaatatgccaaaggtctgggtatgagcctgaatgacgctggcacgctggtaagtaacttctggatgtcgtacatggtcggcatgtgggcgttcagctttattcttcgcttctttgatttgcaacgtatcctgaccgtactggctggtctggctgcgattctgatgtacgtctttaacaccggaacaccggcatatatggcgtggtcaattctcgccctgggcttcttctccagcgcgatctataccaccatcatcaccctgggttcacagcagaccaaagtaccgtcgccaaaactggttaactttgtcctgacctgcgggactatcggtactatgttgacctttgtggttaccggcccgattgttgaacatagtggtccgcaggcggcgctgctgacggcaaacggtctgtacgctgtcgtctttgtgatgtgcttcctgttaggtttcgtcagccgtcaccgtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccggacgtaccgttttttatgacaagctgatcatggcgaccggttcctacccgtggatcccgccaattaaaggttctgatactcaggactgctttgtctatcgcaccattgaagacctcaacgccattgaatcctgcgctcgtcgcagcaagcgcggtgccgttgttggtggcggcctgttaggtctggaagctgctggcgcgctgaaaaacttaggcattgaaacccacgttatcgaatttgcccctatgctgatggcggaacagcttgatcagatgggcggcgagcagctgcgtcgcaaaatcgaaagtatgggcgtgcgcgttcacaccagcaaaaacactcttgagattgtgcaggaaggtgttgaagcgcgtaaaaccatgcgttttgccgacggcagcgaactggaagtcgactttatcgtcttctctaccggtatccgtccgcgcgataagctggcaacccagtgtggtctggacgttgctccgcgtgggggtatcgtcatcaatgattcctgccagacttccgatccggatatctacgccatcggtgaatgcgcaagctggaacaaccgtgtatttggtctggtagcaccaggctacaaaatggcgcaggtcgccgttgaccatattcttggtagcgaaaacgcctttgaaggtgcagaccttagcgccaagctgaaactgctgggcgtagacgtaggcggtattggtgatgcgcacggtcgcacgcctggcgcacgtagctacgtttacctcgacgaaagcaaagagatctacaaacgcctgattgtcagcgaagacaacaaaaccctgctcggtgcggtactggtgggcgataccagcgactacggcaacctgctgcaactggtgctgaacgctatcgagctgccggaaaacccggattccctgatcctgccagcgcactcgggtagcggtaagccgtctatcggtgttgataaactgccggacagcgcgcaaatctgctcctgcttcgacgtcaccaaaggcgacctgattgctgctatcaacaaaggctgccacaccgttgcggcgctgaaagccgaaaccaaagccggtacgggctgcggcggttgtattccgctggtcactcaggtactgaacgcggaactggcgaaacagggtatcgaagttaacaacaacctgtgtgaacactttgcttattcgcgtcaggaactgttccatttgatccgcgttgaaggcattaaaaccttcgaagaactgctggcgaaacacggcaaaggctacggttgtgaagtttgtaaaccgaccgtcggttcgctgctggcctcctgctggaacgaatacattctgaagccggaacatactccgctgcaggattctaacgacaacttcctcgcgaacatccagaaagacggcacctactcggtgatcccgcgttctccgggcggtgaaatcaccccggaagggctgatggcagtaggtcgtatcgcgcgtgaatttaatctctacacaaaaatcaccggctctcagcgcctggcgatgtttggcgcacagaaagacgatctgccagagatctggcgtcaactgattgaagccggcttcgaaaccggtcatgcctatgcgaaagcactgcgtatggcgaaaacctgcgtgggaagcacctggtgccgctacggtgttggcgacagcgtcggcctcggcgtggaactggaaaaccgttacaaaggcatccgtacgccgcacaaaatgaagttcggtgtctccggctgtacccgtgaatgttcagaagctcagggtaaagacgtgggtattatcgccactgaaaaaggctggaacctgtatgtttgcggtaacggcggcatgaaaccgcgtcatgcggatctgctggcagcggatatcgatcgcgaaacgctgatcaaatatcttgaccgcttcatgatgttctacatccgtactgccgacaaactgacgcgtaccgcgccgtggttagaaaacctcgaaggtggcatcgattacctgaaagcggtgatcattgacgacaaactggggctgaacgctcatctggaagaagagatggcgcgcctgcgggaagcggtagtgtgcgaatggactgaaacggtcaatacgccgtctgcgcagactcgcttcaaacacttcatcaacagcgacaagcgtgacccgaacgtgcagatggtgccagagcgcgaacagcaccgtccggcaacgccgtatgaacgtatcccggtaactctggtggaggacaacgcatgagccagtggaaagacatctgcaaaatcgatgacatcctgcctgaaaccggcgtctgcgcgctgttaggtgacgaacaagtagcaattttccgcccgtatcacagcgatcaggtgtttgcgatcagcaacatcgacccgttctttgagtccagcgtgctgtcacgcgggttgattgcggaacaccagggcgagctgtgggtcgccagcccgctgaaaaaacagcgttttcgcttaagcgacggcttgtgcatggaagacgaacagttttccgtcaagcattacgacgcgcgagtgaaagacggcgtggtacagctgcgcggttaatattttaacgggaggcgcaatgcctcccctttttgcatggtcctgtaataactttcggtatattgcaggacattttttaaactttttgttttattttttgtttttattttttaaaggataatcaaatgtttacagacactattactaagtgtgcggctaacgctgcgcgcattgcacgcctgtcggcaaataacccgctcggcttttgggtcagctccgccatggcgggcgcgtatgtgggtcttgggatcatcctgattttcacgctcggtaatttgctcgacccgtccgtacgtcctctggtgatgggcgcgacctttggtatcgccttaacgctggtcattattgctggttctgaactgttcaccggacacaccatgttcctcacctttggagtgaaagcgggcactatcagccacgggcaaatgtgggcaatcctgccgcaaacctggctgggtaacctggtcggttccgtcttcgttgccatgctttatagctggggcggcggtagcctgctgccggtcgataccagcatcgttcactccgtcgcgctggctaaaaccaccgcaccggcaatggtattattcttcaaaggcgcattgtgtaactggctggtttgtctggctatctggatggcgttgcgcactgaaggggcggcgaaatttatcgctatctggtggtgtttgctggcatttatcgcgtccggctacgagcactccatcgctaacatgacgctgttcgcactctcctggttcggcaaccacagcgaagcctacacgctggcgggcattggtcataacctgctgtgggtgacgctgggtaatactttatcgggtgccgtattcatgggattgggttattggtatgctacgccgaaagcgaatcgtccggttgcggacaaatttaatcaaactgaaacggctgccggttaattactaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacagatgatgacgcgcttaaccagcgcgtcagtgaagccgctgaatctcgtcgtatcttctgtaacgtggtcgatgcgccgaaagccgccagctttattatgccgtcgattattgaccgctcaccgctcatggtcgcggtctcctctggcggtacttctccggttctggcgcgcctgttgcgtgaaaaacttgaatcactgctgccgttgcatctgggccaggtagcgaaatacgccgggcaattacgtggtcgagtgaaacaacagttcgccacaatgggtgaacgtcgccgtttctgggaaaaactgttcgttaatgaccgtctggcgcagtcgctggcaaacaacgatcagaaagccattactgaaaccaccgaacagttaatcaacgaaccgctcgaccatcgcggtgaagtggtgctggttggtgcaggtccgggcgatgccgggctgctgacactaaaaggtctgcaacaaattcagcaggcagatgtggtggtctacgaccgtctggtttctgacgatattatgaatctggtacgccgcgatgctgatcgcgttttcgtcggcaaacgcgcgggataccactgcgtaccgcaggaagagattaaccagatcttgctgcgggaagcgcaaaaaggtaaacgcgtggtgcgtctgaaaggcggcgatccgtttattttcgggcgtggcggagaagagctggaaacactgtgcaacgcgggtattccattctcggtggttccgggtattaccgcagcttctggttgctctgcctattcggggattccgctcacgcatcgcgattatgcccagagcgtacgcttaattactggacacttaaaaaccggtggcgagctggactgggaaaacctggcggcagaaaaacagacgctggtgttttatatggggctgaatcaggctgcaactattcagcaaaagctgattgaatacggtatgcctggtgaaatgccggtggcaattgtcgaaaacggaacggcagtcacgcagcgcgtgattgacggtacgctcacgcagctgggcgaactggcgcagcaaatgaacagtccatcgctaattattattggtcgggttgttggcctgcgcgataaattgaactggttctctaaccattaatttaaccagggccagagaagtctggcctttttcgtttacaactctctttatatattcagcagataaaaacatacccccttaataaatattgtctgctaatgggttatattcaccgttacagcgacttacaaaattaaatcaatcgctcactgacgctaattgaatattcctgtatcgttcttaatgagcagtctgcttatattcatataatcaatgaatattaattaatatataatacatagggaatgtaaatgaacaaatttattaaagttgcactggtaggcgcagtactggctacgttaactgcatgtactggtcatattgaaaaccgtgataagaactgctcttacgactacctgctgcacccggcaatttctatttctaaaatcattggcggttgcggtccgactgcacagtaagctattgacagaaatcggctaacgccggtttaattgcctgacgccctcggagttatccgagggcgtatttatttctgcattcttttcgaaaacatcatgcacaagattaaatactggcaatactctcacgcaaaatccgcagcaccgtctcttcaccgctgcgattcgggttaatgcgaatcgcgcaatgttcgagttgtggattcgcctgacgaaacgttccggaaagtcgataaaagagcggcgggatttcatatttcgactctgcaccaaccgggtaaggcaaggcaccgagtttctgcgcctcttccagcactctggcggcaatcggctgatgaaactccacaatcaataccttcgactgtgcattggcaatgacggcgcttttcacttccgccaccgcgccgccgttaagcaaagccagcaaccgttcagatacccccgcctgcaccgcgtgcatcactggcgcgagcaccagaccacgcaacacctctaatgcctgcgccccctgaatctgactgccgccggaatagagcgtggcgcgaatccggctaataacatcggcatcgcctaccaccgcaccaacgccctctggcccaaatagcttgaagcaggaaaatgtcgacacattcgccccgcattcgcagccgattcgcgctaccttcatcaccgcatagttgtcatcggttaacgctggaacacctgccgcgcgcaacgttgccagcacgtctgccagcacatagcggtcctgcggctgctggcgcgtatgctgcaccagcgctgcatcaggttgttgctcgtcaacaacctgcttcagtgccgacagatcattgaaatcagccgtaatgagcgttagtcccatctgctcaataataacccgtgtcgttgggtaaaccggcgcgtcatgcaccagaagacgttgccccggtttgagcaaagccgccagtgccgcacggatcgcgccagtacccgcgccctgtaccagcgccgcagcctgtgcgtgaaatgcatcagccagcacctgttccacacgctgggtaatgcggggctgatttagccccggcgttaagcccaaatcaccgcaggtaagaaactcgctgccaggaaaatgacggcaaatcgtgtccaccagcgcaaactgcttttgctgcgcctcaataagcgtcaggctttgcagaggaaacgtcttcataggtgccttccttaagccggaacgaacaggccaagccagtaaagaacattcagcaggatgccggtgatcattactgctacgaccggtgccgccattttctgtaccggacggcccagggattcgttgaggaagtaaatggcaaccgcgatagagaatccggtatagcccgccattttgattgccgcaaagatcgaaccgaccagcaacgccacttccatcagcatattcatggcgttacggatgttatccgacgcattacgtaccgacgggtagcgccccaaccatttgccgatcgaacgaagcagcaagacttccgccgaaataaccactgcgcctaataccgctgcaaccatcggattcggcgagagatagcccaccgcataaacaaaggtaaagcccgcaactgcatacacaccggtggctaacgcggtggtggcaatcaacggcacaaaacccagcccgcgcataaattctgccagtgccgcctggttgattagtgtttgcgattgttccggcgttacgcctgcggagtacgctttctccagtgtgaagatcgacacttcactaccggcgaaaatcttcatgctggcaacggcagcaatcaatgcacccacgatggcgatatacggtaagtttttgataatccgtgatgtacgctcttcaaacaccgacataccgctggcatcgatatcattttcatcacgatggcgcaggtcatgagttattgcgatccccagcagcatcaccatgccaataaagatttcgatggattcagggttaagatgtgggaaatagcgcactaccaccacacgagtcatcagtaccaccacggcggcgatcagactttgcttccagccaaactggtagaaaatcgccaccaacgggaacagtgcaaaagctgaaaccaccggcgagcttaattcccccaggctacctaatacatccaccggtagcgcggtcagcagctggtttactggcaacagacaggtgaggatcaatattccccagatagcaccaagaccaaacgccatcaggctgtttatcgccagtacgccgaggatatcggtaggaagaaagagtaaccatgcgttgagcagcccggttttcagggtaaaagagatccccaccgaggccacaaaaccaatgctcagaccaaaagcgatactccccgcctcgcgacggttcatatagccttcaatcagttgcggcaggatcgggcggataccgtcatgaaaaacggctgccgagcgatgcgccagaagcgatgtcatacccgtcaggcacgccaccacgataatctgaatgtacagatccatagtcgtgccttttatttcagatggttaatcagcatcggaatcgcgtgttcgacgtgctcaacggaaaggccaaacgccacttttccttcagcgaccattttggcgatatgctcgtctttcgctttaatgcccggcttggcaatggtgcaacttttgttatagccaatcaccgcgatagcaatcgacaatgccgcgcccgcaccggtattacacgcgccgatgtagtaatccagttgcccggatttcactttcattgccgcttccatgtcgttgtgaatgaaaacttcaaaacagccaggagccgtcgcttcaatggtttttttaatctgctcacgctgtaagcctgcaacgccaatctttttcatgagtctgtccttattggaaaaattgagagggattttcacgtaacatcacatccacatcggcctgactgaatcctgactggcgcaattgcggaataaaagtggtcaataaaaagtcatagccataaccaccgttggcttttaaatgagagcgccgcgtaatatccatcgacagcatgacgcgattcagcaccccacggtcacgtagcgcatggagcatcgcaatgcgcttttcgtccgggtagtaactgttcttgccgatggtgtcgaactgcacatacgcgccgagatcgatcatcttcaaaatgttgtcgagattgtctttcagatcgcagtggccgacggtgacgcgcgaaagatcaactccgtgggcttgcaacagagccagttgctccagccccatcgtgctgaacgacgtatgcgtggagatcgggcgtccggtatggttatgtgccagcgcggcggcaataaacaccttctcttccagcgacgtaatcttcccttcgctggagccgatctccgcgataattccggctttcaggtcagtgccatcgataccctgctcaatttcatcgaccatctcctgcgccagttcctgcacgctgcgggtcgccacatgttccgggaaaaacgcgtcctggtaataaccggtacaggccaccacgttgatcccggtttcgcgcattacatcgagcataaattgcgcattgcgccccatgtaacggttggtcatctcaatcacattacgcacgccccgggccatcaggtcgttcatctcctggcaaatgaacgcatactgatcaaggcggcagtccacgttgtttttaaagccggaaagatcaatatgcagatgctcatgggcgagcgtgtagcccgtcggatcaaaactcatagggtgtctcctgcaaaccggaaggaggaaagaaaagagcgaccattttgtggtggtggcgcacggaaaaattcacacacggtagcccccacatcagaaagcgtggtgcgcacaccgagctgcgtagcgaccagtccttgctgataaaccagcactggcaccacttcgcgggtatggtggctgtgaccaatggtcggatcgttaccgtgatccgccatcacgaccaggcaatcatctggctgcatcgcctcaacaagcctggcaaggttacggtcaacgacctgcaaacgttcggcataacgtgcgacgtcttctgcatgaccagcgaggtcggtttcctggatattggtacaaataaacgccgtcggataggtgttaaattcgttgagggtgatatccataatccgctggctatccaccaggttttgccagctcacgccataaggattactggcaatatccgccactttccccaccagcacggttggtacgcccacttcatacagtttttgtggcacctgcactttttcatcgacgccgtagcccatatgtacgacctggaaaccgttgtcataggcgccagaacgcggcgcattgatgccaataaagcgcccttctttgctttctgcggcatcgaggatgcactggctgtcggttaacaggccaccaaatgtaatgacccgaccgacctgtacctgctcacgcacgatacgacccattttgattgcgtcgtcaaaagagatcacagagagattggcggtgatgttatagacctgacctaaatccgcctcgagattatcgccaatcgcaaccgcctgattgacccacagaaattgcagatcatcgccacgacgctcaacctgccagccagcggaaactaatgcctgctcaacacggtcaatcacatcacgaaagggcatccgcagcggcggtaacgggcgcgtacctaaaatttcctgatgccccataaaggtatcgccaccttcatgttgcagctctgccacgccccaggttgcggagtctgacggctgcatatcgccaggcgcataacccaatgcgttgattagccctagcgtctccagcgttggtagctgcaaatgcggcaactggctcaggatgtgaccacaggtattcgccccggcatcctgcggacgcaccaacgtgacatctttcattgcccctacgccaaagctatcaatcactaacaccacaaatcgcgccatttacgcctccagagggttgccgaggctgtcataacgaccaactatttctggttcgccacggtgaataccggacaccagcaccacatcactacgggtgataaaaatctgcgtgcgaaaacagagcaccactgcactgcttaccggatgctcgcctgccagcggcagggtgtagtcgatactgctgtcatcaacggcgttgagatatgtttcagtaattctttgattttctggcgtaaacaccagcgcatgttgcgcgtgaccacgacggtagtaaccgccgccgtagcagtagctgtcgccacggaaatgatgggagatttcacttaaccagagcatcgcgatacgttcaggctgatcgccctgttgatttgccggaatagtacccgtcagcgcatgaccgggttcggtatgagtcacaccgtattccgccagcaatggcagcgacgtgcagctggtcgctgaaggcgcgttcagttgctcaatcgcaataccagatttcgccagttgatcccgtgcttgtaccagcgtgtgaagattcggtgtcggcaaaactttcccggcagcctcatcccaaagcaggcaagggaaatgggtaagtcccgccaaatgtagccccggcagattctggatttcagcaaccacctcgtgcagcgaatgctgtacaaaaccgctctcctgccccggataaagaaaatcatcgtcgctataaactttgagcagcacagactgcacacgtccggtcttcaccgctgccgcagaaatttcccgcgctttgtcgagggtaaacacagtgatgacgtcggttccctgttcaacggcgtcagaaacctgatgacaagggatttgtaccagatgcccctgatgcgctaccggcaaaccggcgcggcgcatgactcgcgcctctttgtaatccaccgccacaatgccgctgtagcccagagccagcagtttttctgccagccacggattacgaccgaattgtttggtcatcagatacagttcaatgccgtaaagccgcgccgtctcaatcagccgcttgccgttttccagaacttgatccacgtcgatcacccaactgtccggggcgatcttgccctgctgccacaaacttagtgcggcggaaatcagcgccgggttctggcgtttcaatgcttctacaaacatcttgttgcctcgtttctgttccttgaattaaatattcatttttttgaatatttaggttgtacgacgtggatttatcgggagcttcaaacctcttcgttagcagccatccataatccataaaggttggccagcaaatagccttcttcacacgggttaacttccagtgcaaattccttcaacaacacctgatgcaattgcacaacggcttgccagtggctggattgcgccagttccgccagcaattcgtcatccagcggctctatttcttcaccacggcgactacgcatcagtgcactcgccatatgtgtcatcgccatcgttccttgctcactgcgcaccggtagatggcactctgtttccagtacattgacgacctgcatcatgcctttgcaaatgtccttatcaataacgcctgcatcgcaaagcaggttgagtctggtttccatatcagatgcctttcgtttaataactgggttcctgttccccactgactactcgctgttgatgagcaagcagggcatgtttatcaacaactgcatgcagcagttgttgcattgggtaatcatcgactcgcgtcaggatcacggcttcggtggcctgtaaaaatcgcggatcgtctgtgagcggcgtcgcttctaatcccagcatggtcagttcgttttccgccactacgttccagataaccgcgtcaacatcgcctttaacaatgcgttgtaaactctcgtgataagagagatcgactcgttccacatcactatcgccaaaaaagacatcggtcatgattttctgatctgccgaacggttatccagccccacgcgcttcacgtttgcggactcgcctttacggcaaatcaactggtgctcgccaacgtaggtatgcggtcccaactccagcgcgaggcataatcctttttgcgtgagataactttccgccgccagtcgcgaaaccaccgccatgtcatacacgccgttaagtaaacactccacgcgaatatccgcgccgcgcatatgcgcatagtaaaaaggaatgccatcaaactgggctttcaatccgctcgccaggccttcgtacaaacgggtatagggcaagggcatcgcacataccacgttgttgatatccacatgagtcagcaatgctttgttatccatctcaaccagataactgccattgcgcccacggcgttcaatccgtatcgctccgcttgattccagcgttttcaacgctgcctgcgtcaggccaaccgatgaacggcattcagttgccagctcatctatggttttcagtcgattaccgcacttttcacccaacaaataacgggccagtgtcgtgataacgacgccttcttttttgataaacgttcgacgcataatatattttcaataaaatgaatgtttatatcttcaggaatttgaagataaggcgcaacagcgagatgtggaaacggcgaggcgcttcacattttttcggattattgcaaatgaggataaaaaaaccgggtttccccggtttttggcattaatgttaaattacggcttcgccacaaaaccaatcgcttcgtacaccgcttttagcgtacgggaagcgtgtgcgctggctttttctgcgccgtctttcatcacctgttgcaggaaggcttcatcgttgcggaaacggtggtaacgttcctgcaattcagtcagcataccggaaacggcatcagccacttcacctttcagatgaccatacatcttgccttcgaactgtttttccagttccgggatgctctggcccgttaccgcagaaaggatatccagcaggttggaaacgcccgctttgttctgcacatcgtagcgaactaccggcggctcgtcggagtcagtgaccgcgcgtttgattttcttcactaccgatttcggatcttccagcaggccgataacgttattgcggttatcgtcagacttggacattttcttggtcggctccagcagcgacattacgcgcgcgccagatttcggaataaacggctccggcaccttaaagatatcgccgtacagcgcgttgaaacgctgggcgatatcgcggctcagttccaggtgctgtttctggtcttcacccaccggcaccagattagtttgatacagcaggatgtccgcagccatcagcaccggatagtcaaacagaccagcgttgatgttctcggcataacgcgcagatttatctttaaactgcgtcatgcggctcagttcgccgaagtaggtatagcagttcagtgcccagcctaactgcgcatgttccggcacgtgggactgaacaaaaatggtgcttttctcaggatcgataccacaagccagatacaacgccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttatagactgataaattacatcaggctggctgagatcgatagcctcgccgtagttatatccgtaggttaagccaactgatgggcaacctgccgcttttgctgcctgaatatcattgcgtgagtcgccaacaaacaacatctgttgtggagcaattcccatccgctcagccaccagtagcagcgggtccgggtgcggttttttattttgcacatcatcaccaccaatcaccacgctgaagtatttggcgatatctaaggcttcgagcagcggcgcgacgaacggcgtcggtttgttggtgaccaggcctagcggcaggcctttagcctgcaacgcgcccaacgtatcggcaacgtgcgggaacaaaaacgtcccctcttcggcaacctcgccatagtagcgatcgaacagtttacgcaggatacgtacctgttcttctgccggaatgtcgtcatcaacgggcggtttacccattgttttacgcagagtcgcacgttcctgacgcgcccaggtcaatgcgcgctccatcagaatatctgcgccgttaccaatccaggtaataacgcgttcttcacctgcgacaggcaactccagcgcatacagcgccatatctaccgcagcagcaagaccgggtgcactgtcaaccagcgtaccgtcgagatcaaaagcgacgccgcgaatatcttcaaacttattcatgacttacctttgccagttcactgcgcatttcatcaatgacttttttgtagtctggctggtcgaagattgccgaaccagcaacaaacatatccgcgcccgccgcagcgatttcgccaatgttgttcaccttcacgccaccgtccacttccagtcgaatgtcaaagccagactcgtcgatacgacgacgtacttcgcgcagtttatccagtgtttgaggaatgaaagactgaccgccgaaaccaggattgacggacatcagcaggatcacatccagcttatccatcacgtaatccagataactcagaggtgtcgccgggttaaataccaaacccgctttacagccattttctttaatcagttgcagcgtgcggtcaacatgctcggaggcttctggatgaaaggtaatgatgctggcaccagcggcagcgaaatcaggcacaatgcgatcgacgggtttcaccatcagatgtacgtcgataggggcggtaatgccgtagttacgcaaggatttcagcaccattggcccaatcgtcagattgggaacatagtggttatccatgacgtcaaaatgcacgacatcagcgccagctgccagggcttttgcggtatcttcacccaggcgggcaaaatcagccgacagaattgagggggcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcaccggaatatggcgatcaaccagaccttcagcgatctccgccagatgcgcttgttgttcaagcgtaaaactgtttgtgtgatacgccgtaaagttggcagtcgcagacagcggcgcataaggcggatcgcaatagacgacagatgcatcatctgcgcgcgccatgctatcggcgtaagactcacaatagaaaaaggcattctgcgctttttcagcgaagtgatacaactctgcttccgggaaatagggttttttgtagcggccaaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcagcgcaatttgtttcgggaacaaacagctcgcgtgcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaacgcccgcaatgataaaccattgcgggagataaccttgattacttcaggtcggcctgtacctgacgcagcggtttcgcccacgggtttttggcctggacatctgctggcaatgtagataccgcttttttcgcctcttctttcgaagcatacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttccctccagcggctggtgttgccgtggtttgcgccggggatgccgtctgtactggagccgtagtcgccgtctcttttggtgctggcgtagaagtcgcagccggtgcctttgtgctcgccacaggggcagctggttcagttcgcttcggcgtctgtgcgactggcttcggttccgttttcacggttgcttgcggttttttcggttcaatcaccgcctgctgacgagccgggcgcgtagtggccggacgttcagcggtttgcgttttcgccgtgtcacgcgatgcattgccattgcgaacaggcgcgacagtcgcgggttcagtcggcaatgtagaattgaccgccacattgttcaactgttgctgattttgtggctgggtcagcgcattgttcaggtcaccctgcacttcaacacgttgttgaccatccgttgccgccggggtttgcccttgagtcggcgtagaagagatcggcggcagagaaacatcctgctgagtattttccgcagacgtggttcccggcgctggctgcacgccattggcctgatcggtcgcattgcctgcaagatcaatactcttctcgccagacgcggtttgatcgctggaagaggtcgagggggcttttagcgcagaaccgataccgatgatcaacagcagtagaaccagaatgccgacacccatcatcatatactgacgagaagcgggtttactggctgcttttttgcgcttacgcggacgacgctctacgcgctcttcatccacggtttcatcttcggattcgtcaatttcttcttcgatttccggttcctcattacgcgctttttgcgcacgagtcggacggcgatcgtcagtgtcatcaagttcaatatcatcaaaattgatctgcggttcgccacgttcagtacgctcagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgcatctctcccgcaaggactttcttgtcacgcagcatatgcggtaaatacgcctgcgcggacatttcgcgcggcccattgaccggtaacccagcccgcgtgagcagggttataatacgctgcgtttcggcagaactaaactgcccgagacgttccgacgtccgcgccgccatcaccatacccgcagcgaccgcttcaccatgtaaccaattgccataccccatttcagcttcaatggcatgaccaaaggtgtgtcccagattcagtaaagcacgtaacccggtttcgcgctcgtcggcggcgacaacttctgctttcagctcacaacaacggcgaatacagtacgccattgccggaccgtccagacgcaacaacgcatccagattctcttccagccagttaaaaaacgcaccgtcaagaataatgccgtatttgatgacttctgccagccccgacgctaactcacgcgggggaagcgttttcagacagtcgagatccaccaccactgaagcgggctggtagaacgcgccaatcatgtttttaccgaggggatggttgaccgcagttttgccgccaacggaggaatcgacctgcgacagtaacgtcgtcgggacttgaatgaaacgtacaccgcgctgataactcgccgccgcgaagccggtcagatcacccactacgccgccgccaagcgccaccagagtagtatcgcgaccatgcggcttttgtaacaatgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggtttgcaaccactttagcgctttgatcatcagtacgaatggtcacgtcggcaatctcttcatacagcggattgcgttcattggccaacgcttccagaacttcacgcggcggtgtttcaacgtgcagcaacgggcgttttttatcacgctgcgtgcgtgcaagttgcttttcgatggtcgtttcaagataaacgacaacgccacgagcggaaagacggttacgcgtttcacgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtaaaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgtaaaaacattaccgcttttacggctgtttactcactggaaaccagtcgtggcgtgataaacaccactaactcgcgtcgttcatcttcttttccgtcatgacgaaataattgcccgaaccagggaatgtcgccaagcaacggtacgctatcctgacccgatttatttttacgggtaaaaatgccgcccagcgccaacgtttctccgcttttgacctcgacctgcgtttcgatctcctgcttatcaatcgccagcacttcgccatctgcctgctgtagcacctgccccggaacgttctggctgatgtgtaatttcagccggatacgacctttttgtaacaccgtgggcgtgacttccatccccaggacggcctctttaaattccaccgacgtcgcgccactttccccgctggaaacctgatatggaatttcgctcccctgtttaatgctggcaggctgaagatgtgaggccagcagacgcggactggcgataatatccagctgctgtttttgttcgagcgcggaaagctcaagatccagtaaacgtccgttgatgcgtccaatgttaaaaccgatatgcgttgtcgccgtcgctacggagaggtcgctgccaagcgtggtgacttgcccaacgccaccagcttgttgcgcatcggccagcgtccatttcacacctaactcacgcaaacttttttcattaatggtgacaatatgcgccgagagctcaacctgcccgaccggcagatccatttgcgatacccactgttcaagcgtgcttaacgccgttttgttatctcgcagcaaaaggcgattggtgcgtttatcgacggtcatactccctttggcactcagtagcttctcccccgctttcgccagctctccggcgtcggcgtattgcagagtaatattgcgattttccagcggcagatttgcctgcgcccgcgtctgctccgcctcctggcgggcgatattgtcattctgccaggcaacggaatgcaccgagagaatgttgccctcctggcgcgttatcaatccggcgcttttcactacagtttgtagtgcctgcttccagggaacgtcagttaaatgtaacgacaccgtaccgctgacgtctggcgaaaccaccaggttcaacttctcctgttcagccagcgcctgcaacacctgagctaccggaacgtcatccaccatcagcgtcactttttgcggctttgccgcctgtacgccgggtataagcatcaacagtagtgcggctatccattgcttcatttgtatctccttgccgttgccacaaccagtgtggcggttcgcagtttgtcccggttcccagcgttagtgcgtctggcgtcagctgtaagatcgtccagccgttttccagcacatcgttttgctgcacccgtcgccattttttttgcccatcttttattacaccgatgatgcgctcgcctcgccctaccatcccctgatagcgccactggctaagttcgctaatccggcatagatcttccggcggtttaaaagggtcacgcataccggttaaaagacacaatgcaatgcctgctaacaaccagcgtttaaccctcatgcggcgtctccagttgtagcgtgaacaaaaggtcatcaccttccacgcttaacgaaaaacggctcacgctgacgttgcgctctgccagccgtgtaaatgccgacggcactgcttcccacagcgttttcaacgccaactcacctccctgcgcggatggatgccagtaaaccagttgcgcgccggataactgaaaatccagtggcgaaaagggcagcgttttttcttcgctgaaggaagtggtgtctaccaggcgatacagtgcagcccactgctggtgatgatttgcccgtagtcgaattaattcatcgctctcttcatggtgtgtcaatgacagaaaaatgagcgtaactaacaccagcaaccagactgcccagcaaaactggcggaggcggagtgatgtggcgaaccaccagtcaaagaacatgttcatcgctaaccttccttgttaactgatactcaaattgccagcgtccctgcgcatcctgctgcgtggcccccctctgattgagatgaaaagaagcatcctggcggagtgacgtttccagcgcgtttaacgcggcaatgcttgttgtcagccccttgatctccagcgttccctgctgccagcttatcgttgtcagccaggcatgttcgggtaaaagcgccgccagtgcttccagcgcagattgccagtcgcgggtaaattgtcgctggcgctgcctttgcaaacgctgttcgcgtaactgctggcgttccagcaaacgtggtttcgttatctgtaagctgcgggcgagttgttgttccgcctgaagcaaaacggcgtttacgcgtgcttcggcattgcttgtcagacgcagtattagcgttatcccgacggccagcagcagaggcgcaacgaacatcagcaaccagaaacgaagaaaagcagtccggcgttgctgtcgccagggcaaaaaattaattggcgggttcatcagtacaccttcccaagcgccagccccagcgcgatggcaaagtctccacctggtggcggtagcggcggctgacgaacagaaaccgcctcccaggggtcaaatccgccttcgccacatagcgcgacgctttcgggatcaacagataacgctgccgccagctccttcgcgctagtcatccccaccgccagtttgcgcccccagctatagcgcgtcgcccacagccactgttcgttatcacgccaggccagacattgctgatgagaaggtaaaaaaggcaggaatcgctgtaatgcactggcatccggagtgatcgcgctaacatgaacacgcaacctttctgccagagtaagcagcgttgccagctctttgctttgcgcggcagtcacgttataggcgggactgagtgagtcttcgctgtaatcgaagcgcagggagtccggatccatatccagttcacgggccatcgtcccggacagccaggccatttgctcccgctcaccgagggacatcgacgggcgtggaaatgaccgctgtaatgtgcgactggcgggaaacgccaacataatgtgatgacgctgcggcagttcacgactccacggtaacaacgtgttagccagccgctgcacatcaacaatccgcccatctttgataatgtcgttctccagtggcaaccgccaccagcggtgcaataagcattcttttgcgctccgcacgatagcaaccgctaccgcttcttgctgttgtaaatgcaaaccaatttgccagttcttaaatgccattgtgatgatctccttatcacccgtcactctgacgggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccgccggagatggtgaaagcctttatcgcgacggaagacagccgcttctacgagcatcacggcgttgacccggtggggatcttccgtgcggcaagcgtggcgctgttctccggtcacgcgtcacaaggggcgagtaccattacccagcagctggcgagaaacttcttcctcagtccagaacgcacgctgatgcgcaagattaaggaagtcttcctcgcgattcgcattgaacagttgctgacgaaagacgagatcctcgagctttatctgaacaaaatttacctcggttaccgcgcctatggtgtcggtgctgcggcacaagtctatttcggtaaaactgtcgaccaactgacgttgaacgaaatggcggtgatagccgggctgccgaaagcgccttccaccttcaacccgctctactcaatggatcgtgccgtcgcgcggcgtaacgtcgtgctgtcgcggatgctggatgaagggtatatcacccaacaacagttcgatcagacacgcactgaggcgattaacgctaactatcacgcgccggagattgctttctctgcgccatacctgagcgaaatggtgcgccaggagatgtataaccgttatggcgaaagtgcctatgaagacggttatcgcatttacaccaccatcacccgcaaagtgcagcaggccgcacagcaggcggtacgtaataacgtgctggactacgacatgcgccacggctatcgcggcccggcgaatgtgctgtggaaagtgggcgaatcggcgtgggacaacaacaaaattaccgatacgctgaaggcgctgccgacctatggtccgctgctgcctgccgcagtcaccagcgccaatcctcaggaagcaacagcgatgctggcagacgggtcgaccgtcgtattgagtatggaaggtgttcgctgggcgcgtccttaccgttcggatactcagcagggaccgacgccacgtaaagtgaccgatgttctgcaaacgggtcagcaaatctgggttcgtcaagttggcgatgcatggtggctggcgcaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctgacgctggcaagtatgttgaacgatgtgccaatttcccgctgggatgcaggtgccggttctgactggcagccgaagaactcaccaccgcagtatgccggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcgtccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacacaccgctggcattcctgattaagagtgccttgaacaccaatatttttggtgaaccaggctggcagggtactggctggcgagcaggtcgtgatttacaacggcatgacataggcggaaaaacgggtaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctgacgccgccaccgggtattgtgacggtgaatatcgatcgcagcaccgggcaattagctaatggtggcaacagccgcgaagagtatttcatcgaaggtacgcagccgacacaacaggcggtgcacgaggtgggaacgaccattatcgataatggcgaggcacaggaattgttctgattaaaaaggcgcttcagcgcctttttaagtttgctgacaaagtgcactttgtttataccggatgcgggtgaacgcgttatccggccaacaaaaaattgaaaattcaataaattgcaggaacttcgtaagcctgataagcattatgcatcaggcaaacttcacgcatttacactcgcccctgccctttcaaccattcgcgcacgaggaacagcgcgctgacattacgcgcttcgttgaagtcaggggcttccagcaaatccatcatatgcgccagcggccagcgcacctgtggtaacggctctggctcatcgccttccagtgattccgggtagagatcttgcgctaccacgatattcattttgctggaaaagtaagacggtgccatgctgagcttcttcaaaaaagtcagatcgttcgcaccaaatccaacctcttcttttagctcgcggttagcggcttcaaagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctttcgacggtaaacagtcgggaacgggctacagtttcaacattcagaatggtgggtttttgtaatgatttgctcatcgtgggatctatgctgtgaaatcagcggttattgtgcgatatcggacacgctttcggcaatgtgaattgcgtgttatttacatttatgtaacttaataaataatcgtcctcaaatcaaattaaaagtcaataggttgaaataactccaggaatttgctgatattccgccttcagagggtttgctatgatcagcggttactgtgatgtgcttaatgatgctcaagttaaactccacgcttgccgatagccaaccgcagaatcatgtattgtgtccggtgcgactgaccacgcctgacagactaagtaagatggggaaagcatgagcaccattgtgatttttttagctgctttgctggcctgctcactacttgcgggatggctgataaaagtgcgatccagacggcgtcagctgccctggaccaacgccttcgcggatgcgcaaacgcgtaaactcacatctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttatggcatctctaccgacgatccgaataaatggcgttactacctcgattcggtagaagtccacctgccgcctttctgggaacagtacatcaacgatgagaataccgttgaactgattcataccgattcgctgccgctggttatttcactcaacggtcatacgctgcaggagtacatgcaggaaattcgcggctatgccttgcaacctgttccgtcaacgcaggcgtcgattcgcggggaagagagcgagcaaatagaactgctcaatattcgcaaagaaacgcacgaagagtatgcgctgagtcgtccgcgcgggctgcgcgaagcgttgctgattgtcgcctccttcctgatgttctttttctgcctgattaccccggatgtctttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatcttggtcaacaaaccgatatcgatatctatctcgaccgccacgtagtgcgtcaggggcgatatctttcgctgcatgatgaagtaaaaaactttccgttacagcactggctgcgcagtacgattattgctgcgggctcgctattggtgctgtttatgctgttattctggatcccgctggatatgccgctgaaattcaccctctcgtggatgaaaggcgcgcagaccattgaagccaccagcgtgaaacaactggctgacgctggcgtgcgggttggcgatacattgcgtattagcggtacgggaatgtgtaatattcgcacttccggtacctggagcgcgaaaaccaactcaccttttttaccgtttgactgctcgcagatcatctggaatgacgcccgctcattgccattaccagaatctgaattggtcaacaaagcgacggcattgaccgaagcagttaatcgccagctgcaccctaaaccggaagatgaatctcgcgtcagtgcctcattacgttcagcaattcaaaaatccggtatggtattgcttgatgattttggcgacattgttctgaagacagcagatctgtgttctgccaaagatgactgtgtgcgactgaaaaatgcgctggtcaatctcggcaacagtaaagactgggacgcgctggtaaaacgcgccaacgccgggaaactcgatggcgtgaatgtgttattacgcccggtgagtgcggaatcgctggataacctggtggccacctctaccgcgccgtttatcacgcatgaaacggcgcgagcggcacaatcactaaacagtccggcccccggcggattcctgattgtcagcgacgaaggcagcgattttgttgatcagccctggccttcggcatcactttacgactatccgccgcaagaacagtggaacgctttccagaaactggcacaaatgctgatgcatacgccgtttaacgccgaaggtatcgtcacaaaaatcttcactgacgccaatggtacgcagcatattggccttcatccgatcccggatcgttccggcctgtggcgctatctcagcaccacgctgctgctactgacgatgctgggtagcgccatttataatggcgtacaggcctggcgtcgttaccagcgccatcgtactcgcatgatgaagattcaggcctattatgaaagttgcctgaacccgcaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggagttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaaacagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtcttaaagctgaaagaacgctgtttattgatgacagcgaagcgattctcgatgctgccgcgcaatttggtattcgttactgcctcggtgtgactaatcctgactccgggattgccgagaaacagtatcaacgccatccgtcactgaatgactaccgccgcctgatcccctcgctaatgtgaaggagatgccatgaaagaaaaacctgctgttgaggttcgactggataaatggctatgggctgcccgtttttataaaacccgcgcgctggcccgtgaaatgattgaaggcggtaaggtgcattacaacgggcagcgcagcaagccaagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcatccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgttcgcggcgaactggtaaccgtttcggaaaccctgcaacagatccttgagaatcacgattatccgcagcccgttaagaacgtgctggcagaactgctggttgcgaccagcctgttaaccgctacgttgaagtttgatggtgatatcaccgtacagctgcaaggcgacggtccgatgaatctggcggttattaacggtaacaacaaccagcagatgcgcggtgtggcgcgcgtgcagggcgaaattccagaaaatgccgacctgaaaacgctggtcggcaatggttacgtggtgatcaccatcaccccgagcgaaggcgaacgctatcagggcgtggttggtctggaaggtgataccctggcggcctgcctggaagattactttatgcgttctgaacagctgccgacgcgcctgtttattcgcaccggcgacgtagacggcaaaccggctgcaggcggaatgttgttgcaggtaatgcctgcgcaaaatgcccagcaggacgactttgaccacctggcgacgctaaccgaaaccatcaaaaccgaagaactgctgactttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagtcgatagcatcctggcggaagatggcgaaattgacatgcattgtgattactgcggtaaccactatctgttcaatgcgatggatattgccgagatccgcaacaacgcgtctccggcagatccgcaagttcattaatgagtatgtccggcagagaggactctgccggattttacgactaatacacctgatgcgctttgtcactcattcagattcacatccagcctttcaccatccactacaagatcgcgccacgctttaggcctcgtccccagctttccatccttcgcagcagcgagtaatttttctttcgttatttggcgcggaagtaaactcatatcaagcgcgtcccattcttttctggctgagtcaaagccatagacaatgactctgtcatcattaaaagcaaacaggatccgctccgcctgaccatcactattcagatcttgctcgaccagtacgcaggcgtctttttcaatacaggtcatcacgttatagcgttctttgattaatgccgaccagaatgccacatccggtttgccagaacctggtgcaattaacacattttcggctaatgatttttccgacaccaccttctgaagactttgctccccatctaacgccatcaacagatcccgcgcacgtttcgggtctttcataaacccggcatcgcttttcagcgactcaagcgccgcacgtccatagcgaccgctgtgttcgagcatgtagatagttacctggtctggcgtgtttttaccgctctgataacgcgccatatgactgttcacgctaatgcgcatactgtccagcaccggcgaattaagaagcaccagtatcaccaacaccaataccgaaaccgcaaggttcactttgccttgaagaacaaggggattttgccctttacgccagacaatgctgacaaaataccccagcgaccacaccagtaacaccagcaccgccagcgcgccctgcaagcggtcgacagtccagccgtactgagcgacccgcagccataacgcccaggcggcgacgaacacatacagcggagcaaccagcaaagcggttttaatcaggcaacgcaatggccccgtccagggaagtgacgctttttgcggatcgcggacaatagccattaagatcaattgcaaaaaggccagcgttaacagcaacccagcggcggagatgtggcgagaaatcgcgctcaggcccgtaaacggcagggtgataataaacatcagggttagcaatgatactaacggcagcaaccccgtggcgattaacgtgaacaacttttgaatagagtcgattaaacgtgactgtgttcgcgcgaggatcaccgccagcgcggtaaccagacctaacgtgagataaataaacccgtcggttgcaaaaaagagcgttttgaaaaacgtgatgccaacaagtttaaacaactcactccacagtaaaagcaccagccacgtcaggccattggcgagaaaaatcaccagtaatataagtacgatactgactggtaaaagtagcgatagcggctactgtcattgcggatgcgaaggctttgttgtatccacggtagcaacaacattgccatcagcagcagatagcagccaaaatcccaaagcgccttttctgctctccagtggttcatgccatcaatttgccactttagccaaccgctcattcccagcgtggcaataaacaccagcgccagccatccccaaaggcgcttctgtttaaaggagatcacggagaagagtaaaacggatgaaaacgcgacggtcgcaggcacgccataaacaatccaactgtgattttttccggcaagccaagcgatcagcaggtagcaaaccagcccctgaagtaatccggtagcaatcatcccccagcgtgttgccggtgaaagttcaacgttatccatgttggttatccagaatcaaaaggtgggttaattatcgcatccgggcagtagtattttgcttttttcagaaaataatcaaaaaaagttagcgtggtgaatcgatactttaccgattgaatttgcatcaatttcattcatgaatgcgattccactcacaatattcccgccatataaaccaagttttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgacctgctgtatcaggaagagctcgatccgagcctgacaggttatgagcgcggggtgttaactaatctgggtgccgttgccgtcgataccgggatcttcaccggtcgttcaccaaaagataagtatatcgtccgtgacgataccactcgcgatactttctggtgggcagacaaaggcaaaggtaagaacgataacaaacctctctctccggaaacctggcagcatctgaaaggcctggtgaccaaacagctttccggcaaacgtctgttcgttgtcgacgccttctgtggtgcgaacccggatactcgtctttccgtccgtttcatcaccgaagtggcctggcaggcgcattttgtcaaaaacatgtttattcgcccgagcgatgaagagctggcaggtttcaaaccagactttatcgttatgaacggcgcgaagtgcactaacccgcagtggaaagaacagggtctgaactccgaaaacttcgtggcgtttaacctgaccgagcgcatgcagctgattggcggcacctggtacggcggcgaaatgaagaaagggatgttctcgatgatgaactacctgctgccgctgaaaggtatcgcttctatgcactgctctgccaacgttggcgagaaaggcgatgttgcggtgttcttcggcctttccggcaccggtaaaaccaccctttccaccgacccgaaacgccgcctgattggcgatgacgagcacggctgggatgatgacggtgtgtttaacttcgaaggcggctgctacgcgaaaactatcaagctgtcgaaagaagcggaacctgaaatctacaacgctatccgtcgcgatgcgctgctggaaaacgtcaccgtgcgtgaagatggcacaatcgactttgatgatggttcaaaaaccgagaacacccgcgtttcttatccgatctatcacatcgataacatcgttaagccggtttccaaagcgggccacgcaacgaaagttatcttcctgaccgccgacgcctttggcgtgctgccgccggtttctcgtctgactgccgatcaaacccagtaccacttcctctctggcttcaccgccaaactggccgggactgagcgcggcatcaccgaaccgacgccaaccttctccgcctgcttcggcgcggcgttcctgtcgctgcacccaactcagtacgcagaagtgctggtaaaacgtatgcaggcggcaggtgcgcaggcgtatctggttaacaccggctggaacggtactggcaaacgtatctccattaaagatacccgcgccattatcgacgccatcctcaacggttcgctggataacgcagaaactttcactctgccgatgtttaacctggcgatcccaaccgaactgccgggcgtagacacgaagatcctcgatccgcgtaacacctacgcttctccggaacagtggcaggaaaaagccgaaacgctggcgaaactgtttatcgacaacttcgataaatacaccgacacccctgcgggtgccgcgctggtagcggctggtccgaagctgtaatgatttgaagctggagaatatctatccagtatcttatagaaagcaaaacgggaggcaccttcgcctcccgttttatttacccttcttttgtcgcaccctgcgcccgcgttaccggcactggcagccaggcgcgaatggaaagcccgccccgttcgctggtgccaagctccagcatcccgttatggttatccacgatacgctgcacaatcgccagccctaatcccgtgccgctaatagtgcgcgcactgtcgccacgaacaaacggctggaacaggtgcttacgctgttctggcgcaatacccggaccgtcatcttctacctggaaccaggcgcgattcggctccgtgccgctgctgactttgatccagccattgccatagcgggcggcgttcaccaccatattcgctaccgcgcgtttgatcgacagcgggtgcattttcacctcaatgctaccggggtaaagcgcagtttcaatttcccgctcatagccactttcggcagcaataacctcaccgagtactgcgttgagatccgccatttccatcggcatctcctgcccggtgcgcaggtagtcgataaactgctcaatgatggcgttgcactcttcgatatctttattgatcgattctgccaggtagccatcctgctcgctcatcatctcggtcgccagacgaatacgcgtcagcggcgtgcgcagatcatggcttacccccgccatcagcagcgtgcggtcatccgccagttgcttaacaccagccgccatatggttaaaggcgcgggtaacggaacgcacctccgaagcgccatattcacgcagcggcggcggaataatccctttacccacctgcaaggctgcgtgttcgagatcgaccaacggtcggttctggatacgaataaacagccacgccccgcctatcgccaatagcataatcgccaacgtataacggaacagcggggagaaatcgccctgatgaatttcggttagcggcacgcgtacccagatattgggcgacaaccaggttttcagccagacgacaggcgaacttttgttgacctcgacgcgaacttccgtcggaccgcccagttgctgcgccatctgatggcttaagaattcatagtgttgcgcccaacgcagacctgcctcttcggcagcttcgttggaatagagagagatccccagctcacggtagatctcccgacggaaagcgggaggcacaaccaactgcgtgccgtcctccagttgcagtttgtcggtcatcaacatacgcacttcgtacgcgaggactttattaaactgctggaggctcggcaaaatcgcgaagttcagcaccaccagataagtcgtcaccaggctgacgaacagcaaggtgacgatgagcaataacgtacgggcaaatgaacttcgtggcgagaagcgcaatcgcctcatgctttagaaccgtccggtacaaagacgtagcccagaccccagacggtctgaatgtaacgcggatgcgccggatcttcttccaccatgcggcgcagacgcgaaatctgcacgtcgatggagcgttccattgcggaatattcacgaccacgggcaaggttcatcagcttatcgcgggagagcggctcacgcggatggctgaccagtgccttcagtaccgcaaactcaccactggtgagcggcatcggctcgtcttcgcggaacatttcgcgcgtaccgaggttaagtttgaacttaccgaaagcaattaccgcctcttcctgtgacggtgcgcctggcagttcgttcgcctgacgacgcagcaccgcacgaatgcgggccagcagttcacgcgggttaaacggttttggaatgtaatcgtcagcgccaatctccaggccaacgatacggtccacttcttcccctttcgccgtcaccataatgatcggcatcggattgctctggctacgaagacgtcggcaaatcgacaagccatcttcaccaggtaacatcaaatccagtaccataagatggaaagattcacgagtcagcaggcgatccatctgttctgcattagcgacgcttcgaacctggaagccttgttcggtgagataacgttccagcagcgcgcgcaggcgcatgtcgtcatcaaccaccagaatcttgtagttctcttgcattgtttgtactcccaaaggttcgcaacaatttgtaagcgtgtattcttaaaaaagctcacgttcgtcaccagctaaatctggtatgaatttcagcctaaattgttacaaagcatattaaacagcagcttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaagaaagtgacctgggccgcaagtctgggcgaccgcagcgaaaatgctgactatcagtataataaaaagcgcctgcgtgaaatcgaccgtcgcgtgcgctatctcactaaatgcatggaaaatctcaaaatcgtcgattactccccgcagcaggaaggcaaagtcttttttggtgcgtgggtggagattgaaaacgacgatggtgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaatgccatcaacgccaccctaagcaaaaccgaactcgaagacctctacctgccctacaaacctaaacgccgcacccgtgggcaaatcgccattgaagcagggcttgagccgttggccgatctgctgtggagcgatccgtcacacacgccagaagtcgccgctgcacaatatattgatgccgataaaggcgtggcagataccaaagccgcgctggacggcgcgcgctatatcctgatggaacggtttgccgaagatgccgcgctgctggcgaaagtgcgtgattatctgtggaagaacgcgcatttggtctcaaccgtggtgaatggtaaagaagaggaaggggcgaaattccgcgactatttcgatcatcacgaaccgctgtccacggtgccttctcaccgcgcgctggcgatgttccgtggtcgtaacgaaggcatacttcagctttcgctgaatgccgatccgcagttcgaagagccgccgaaagagagctattgcgagcaaatcatcatggatcaccttggcctgcgcctgaacaatgccccggcggatagctggcgcaaaggtgtggtgagctggacgtggcgcatcaaggtgttgatgcatctggaaactgaactgatgggcaccgtgcgcgaacgcgcggaagatgaagcaatcaacgtctttgcccgtaacctgcacgatctgctgatggcggcccctgccgggctgcgtgcaacgatgggcctcgatccgggtctgcgtaccggggtaaaagtggcggtagtcgatgcgacaggtaaactggtggcagccgataccatttatccgcataccgggcaggccgcaaaagcagcgatgaccgttgctgcgctgtgtgaaaagcataacgttgaactggtggcgattggcaacggtacagcttcccgcgaaaccgaacgtttctatctcgacgtgcagaagcagttcccgaaagtgaccgcgcagaaagtgatcgtcagcgaagctggcgcgtcggtttactcggcttccgagctggcagcacaggaattcccggatctcgacgtttcgctgcgtggcgcggtgtctatcgcccgtcgtttgcaggatccgctggcagagctggtgaaaatcgatccgaaatctatcggcgtaggtcagtatcagcatgacgtcagccagacgcagctggcacgcaaactggatgcagtagtagaagactgcgtaaacgccgttggcgtcgatctcaacaccgcttctgttcctctattaacccgcgtggcgggcctgacgcgcatgatggcgcaaaacatcgtggcctggcgcgatgagaacggccagttccagaaccgtcagcaactgttaaaagtgagccgtctggggccgaaagccttcgagcagtgcgcgggcttcttgcgcattaaccacggtgataacccgctggacgcttctaccgttcacccggaagcctatccagtggtggaacgcattctggcagcaacacagcaggcactgaaagatctgatgggtaacagcagcgaactacgtaacctgaaagcatctgactttactgatgagaaattcggtgtgccgacggtaaccgacatcatcaaagagctggaaaaaccgggtcgcgatccgcggccggaatttaaaaccgctcagtttgccgatggcgtcgagacaatgaacgacctgcaaccgggtatgatcctcgaaggtgcggtgaccaacgtcaccaactttggcgcgtttgtcgatattggtgtgcatcaggacggcctggttcacatctcttcattgtcgaacaagtttgtggaagatccgcataccgtggtgaaagcgggcgacattgtgaaggtgaaagtgctggaagtggatcttcagcgtaaacgtatcgccctgaccatgcgtctggacgagcagcctggcgaaaccaacgcccgtcgcggtggcggtaacgatcgcccgcaaaacaaccgcccggcagccaaaccgcgtgggcgtgaagcgcagcctgccggtaatagcgcgatgatggatgcgctggcggcggcaatgggcaaaaaacgttaaacgcccggactggcccctaaacctgcgcgattaggcgttcacgccgcatctggcaatgaacgccttgcctgacataaaagtgccggagaatatctccggtctttttattccacaagcaaactcataatagattccgttaatatttatcacttcattaacaactgaaaccttaattaaacattaaccagccctaataattcgtcatgcgaattatattttcgctgcgatataaccttgagccatatcaacattgagtcagattattattcaaaccaacattcacacacattttaagtattgctgatagaaaccattctcattatcattgtactgttgattatttaatctctccttcgttggcaaatcatctggtctcatgtcgctgtcaaacgccccatgaggtagttatccagttaatgagaaacaagtaggcacctatgcaatacactccagatactgcgtggaaaattactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccattggcttaattggtaatccaaattctggcaagacaacgttatttaaccagctcactggctcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgcagacctgctgattaacgtggtggatgcgtctaaccttgagcgtaacctgtacctgacgctgcaactgttggaactcggcattccatgcatcgtggcgctgaacatgctcgacattgccgagaagcaaaatattcgcattgaaattgatgcgctgtcggcgcgtcttggctgcccggtgatcccgctggtttcaacccgtggtcgcggtattgaagcgctcaagctggcgattgatcgctataaagctaacgagaatgtggaactggtgcattacgctcagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatctggatgccgccctcgcccgtctgcgtaatgagatggacgatccggcgctgcacattgccgatgcgcgttaccagtgcatttctgccatctgtgatgtggtaagcaacaccctgacggcagaacccagccgtttcaccactgcggtagataaaatcgtgctcaaccgtttcctcggtctgccgattttcctctttgtgatgtacctgatgttcttgctggctatcaacatcggcggggcgttacagccgctgtttgacgtcggctccgtagcactctttgtgcatggtattcagtggattggctacacgctccacttcccggactggctgactatcttcctcgcccaaggcctgggcggtggtattaacaccgtgctgccactggtgccgcagatcggcatgatgtacctgttcctctccttccttgaggactccggctatatggcgcgtgcggcgtttgtgatggaccgtctgatgcaggcgctgggcttgccggggaaatcctttgtaccgctgatcgttggtttcggttgtaacgtaccgtcggtaatgggcgcacgtacgcttgatgcaccgcgtgaacgtctgatgaccatcatgatggcaccgtttatgtcctgcggcgcgcgtctggctatcttcgcagtattcgcggctgccttcttcgggcagaacggtgcgctggcggtcttctcgctgtatatgctgggtatcgtaatggcggtgctgactggcctgatgctcaagtacaccatcatgcgcggtgaagcgacgccgtttgtcatggagctgccggtctaccatgtaccacacgttaaaagcctgattatccagacctggcagcgtctgaaaggcttcgttctgcgtgctggtaaagtgattatcatcgtcagcattttcctgagcgccttcaacagcttctcgctgagcgggaaaatcgtcgataacatcaacgactcggcgctggcttccgtcagccgggtgatcaccccggtcttcaagccgattggcgtacatgaagataactggcaggcaacggttggcctgtttacaggtgccatggcgaaagaagtggtggtgggtacgctcaacaccctctacaccgcagaaaatattcaggacgaagagttcaatccggcggaatttaacctcggtgaagagctgttcagtgcggtagatgaaacctggcagagcctgaaagacaccttcagccttagcgtactgatgaaccccattgaagccagcaaaggcgacggcgaaatgggtaccggggcgatgggcgtgatggatcagaaattcggtagcgcagctgccgcatacagctacctgattttcgtcctgctgtacgtaccgtgcatctcggtgatgggtgctatcgcccgtgaatcaagccgtggctggatgggcttctccatcctgtgggggctgaatattgcttactcactggcaacattgttctatcaggtcgccagctacagccagcatccaacttacagcctggtgtgcattctggcagttatcctgtttaacatcgtggttatcggtctgctgcgccgcgcgcgtagccgggtagatgtcgaactgctggcaacgcgcaaatcggtaagcagttgctgtgcggccagtaccactggcgattgccactaaggacacgacaatggcttcgctcattcaagtgcgtgatttgctggcgttacggggccgtatggaagcggcccagattagccagacactgaacactccgcagccaatgattaacgccatgctgaaacagctagaaagtatgggaaaagcagtgcggattcaggaagaacctgacggctgtctttccggcagttgtaaaagctgcccggaaggaaaagcctgtctgcacgagtggtgggcgctgcgttaaccatactccatcacctgttttgaaaagcccggtatgcgtttgcatccgggcttttttgcgtgcggctttccataaaaatgcaacccttgcagcgcgacgtaaattcctctgaaagcgtctcgcagggatgaaaactcgctaatgcacaggtgtggagtggcgcgtagagtcgcggcattcaaacaacaggtgaaggaacgccatgagcaaaaagcagagttccaccccacacgatgcgctgttcaaactctttttacgccaaccggagacggcacgcgattttcttgcgtttcatttaccggcacccattcacgcgctctgtgatatgaaaaccctcaagctggagtcgagcagctttattgatgacgatctgcgtgaaagctattccgacgtgctgtggtcggtgaaaacggaacaaggaccaggatacatctattgtctgattgaacatcaaagcacctcaaacaaactgatcgcatttcgcatgatgcgctacgccattgccgcaatgcaaaatcacctggatgccggatacaaaaccttgccgatggtggtgccattgttgttttaccacggtattgaaagcccctatccctattcgctgtgttggcttgattgtttcgccgatcccaacctggcaaggcagctttatgcctctgcatttccgctgattgatgtcaccgtcatgcctgatgatgaaatcatgcagcaccgacgtatggcactgctggagttaattcaaaaacatattcgtcaacgcgacctgatggggctggtagagcaaatggcctgcttattaagtagtggatacgctaatgacagacaaatcaaagggctgtttaattacatcttgcaaaccggcgatgcggtacgttttaacgattttatcgacggcgttgccgaacattcaccgaaacacaaggagaacttaatgactattgcggaaagattgcggcaggaagggtttcagaaaggtatacgtaccaacgccctaaatattgccaaaaccatgctggacgccggagtttctcttgaggacgttctgcgatttaccagcctgacggttgaagaccttgctgaaataaatcatcaataacgtaaaggatggttttaatgacagatgcagaaagagaatatcttattatttacctgattggttatttattgggtcgacgcctggaagccctggatatcgccaaaagaatgctgtaatccggagtccctcttgcggacatcatgcgttttaccggggtgtcagaagaagagttggctgcggcgagtcagtaaagttctgtctcgccatttcaaaagctgtctacaccctctgcttcaacgccaccagcaggtgatgaaactcgaccggatgcgaaataaacggcgcatgggccgctttggcgaaaatgtacgactcgctgtgcggccagagtttatccagcatcggcactactttgcgcggcaccagaccatcaagatagccatacaatcgcaaaaacggcatggacacgttttgcagcggcagacggagatcgaccgttttgaggatttccagcccaccattgagcacgtccacctccggcatcggtaacgccagtacggttttcttcaacgcccgcgcatcctggcgcgccgtttcagtacccatggtttgtaacgccaggaaccgctccactgtacgctgaaaatcatcactgagttgctgctgaaatcccgccagcacgtccggttttatccccggccactcgtcgcgagcactaaaacaaggtgacgacgccacggtgaccagcgccagaacccgctcgggatgggttaacgcaatctggcttgccaccagcccgcccagactccagcctaaccaaatggctttatctggtgcctgtcgcagcacgacttcggccatatcagcaagtgatagcgcaccaaatccccggctacgcccgaagccgggcaggtcaacaaggtgcagcgtaaaatgcgagctaagttcctcgtcaatgcaacgccacacttcggcattcagtccccatccgtgcagcagcacaagatgaacattcccctgacctttggtctgccaccagatgttattcatccgctattgttctctttttacttacaaggatgaacatatgctaacagtaccgggattatgctggctatgccgaatgccactggcgttaggtcattgggggatttgttcggtctgctctcgcgccgcccgtacagataaaacgttatgcccacaatgtggattacccgccacacactctcatcttccctgcggtcgctgcctgcaaaaaccgccgccctggcaaagactggtcacggtcgccgactatgcgccgccattaagtccgctcattcaccagcttaagttttcccggcgcagtgaaatcgccagcgccctgtcacgtctgttactattggaagtcttacacgctcgtcgcaccaccgggttgcaactgcctgatcgcatcatcagcgttccgttatggcagcgccgtcactggcgtcggggatttaatcagagcgatttgctgtgtcagccgttatcacgctggctacactgccaatgggatagcgaagccgtcacacgaacacgggccaccgcgacccagcattttcttaacgcccggctacgcaaacacaacctgaaaaatgcctttcgccttgaattgcctgtgcaaggtcgccatatggtgattgtggatgatgtcgttaccaccggaagtaccgtcgcagagattgcgcagttgcttttacgcaatggtgcggcgactgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaaccaggaagaagggacacaaatccgcgtatttgtgattaaccctggcacgcctaacgctgaatgtggcgtttcttattgtccgccggacgctgtggaagccaccgacactgccctgaaatttgacctgctgaccgcgtatgttgatgagttaagcgctccttacctggaagatgcagagatcgattttgttaccgaccagttgggttcgcagctgacgctgaaagcgcctaacgccaaaatgcgtaaagtggctgacgatgcgccgctgatggagcgcgtggagtatatgctgcaatcacagatcaacccacagcttgctggtcacggtggtcgcgtttcgctgatggaaatcaccgaagacggttacgccattttgcaatttggcggtggctgtaacggttgttccatggtcgacgtcaccctgaaagaagggatcgaaaagcagttgctgaacgaattcccggagctgaaaggtgtacgcgatctcaccgaacaccaacgcggcgagcactcttactactaagttctctccccttttgtcgattgcccgatgtgacgctaaagcgtcttatcgggcctgtacgttgcacgagagtctgacgttagcgcagaattacctcagcaaatccaatctcttcgtttccccacgataatatgaccaacctctcataatttaaatttaccccgctctggtgattctcaagcacgtaatgttacccgtatcattctcatgggcaccaaacacactcataacatctgactacactaactcgttttaggggtcatcagccgtggtgccgtaacatctctgttcccagttgggacaaccaggattttccgtcagaaacctgacgttacccataacaaattaaaggccaggtaaatcatgccattagtcattgttgctatcggtgtaatcttgttattactcctgatgatccgcttcaaaatgaacggcttcatcgctctcgtcctcgtggcgcttgctgttggattaatgcaaggaatgccgctggataaagttattggctccatcaaagctggtgtcggcggaacgctcggtagccttgccctgatcatgggttttggtgcgatgctgggcaaaatgctggcagactgcggtggtgcacaacgtatcgctaccacactgattgccaaatttggtaaaaaacacatccagtgggcggtggtactgaccggttttaccgttggttttgccctgttctatgaagtgggtttcgtgctgatgctgccgctggtgtttaccatcgcggcttccgcgaatattccactgctgtatgttggtgtaccaatggcggctgcactgtctgtgacccacggcttcctgccaccgcatccgggtccgactgcaattgccaccattttcaatgccgatatgggtaaaactctgctgtacggtactattctggcaatcccgaccgtgattctcgccggtccggtttacgctcgcgtgctgaaaggtatcgataagccgatcccggaaggtctgtacagcgcgaaaaccttcagcgaagaagagatgccgagctttggcgtcagcgtctggacctctctggtgccggtggttctgatggcgatgcgtgcgattgccgaaatgatcctgccgaaaggtcacgctttcctgccggtagcggagttcctcggtgacccggtaatggctacgctgattgccgtgctgatcgcgatgttcacctttggtctgaaccgtggtcgttcaatggatcagattaacgacacgctggtttcttccatcaaaatcattgcgatgatgctgttgattatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgtcgcggcaatcactgcgggtggtatcgcggcaccgctgattgcaacgacgggtgttagcccggagctgatggttattgcggttggttccggtagtgtgattttctctcacgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttgataatactgatggccggatgcggcgtgaacgccttatccggcctacgattcggcattaattagtaggccggataagacgcgtcaagcgtcgcatccggcatcaaccgcactctacttcttcttcgctgccgctctgcgccgtctgtccaaatccttcagcaatttgttcacaccatcatcggcaaacatcgactcaagcgttgcggaaagtttacgtcgccagtttttatactggtaactggtgccgggaatatttaccggatctgccatatccagccagtcttccggctgtagccctaacagggcgctgttgctatcggcgatgtagcgctgtaagccacgattcagcgtcggtgtcatcgacatcaacgatgccttatgcccggcacgttttggcaggcaaccatatttatgcagagcatccagcagcccttgcttcgccagttcgcgatcctgatacagaccgcgcagtaccacttcatccggatacaaccccagcgttttgcccagcgttaaatccccactctcccagtagccgcgtagcgtaggcaggtcgtgtgtcgccgcaaccgccatcgactgctctgggtacgctttcggtgcgcggaatgtcttctcgtggtcgttttcgaaatagagcactttgtaggagtacacaccgctgctgcgcagcttaccgacaatctctaccggtacggtaccgagatcttcaccaatcaccatacagcgatgacgtttactttcgagtgccagaatcgagagcagatcatccaccggatagtgaacatacgcgccctgatctgccgtctcgccatacggtatccaccacaaacgcagcatcgacatcacgtgatcaattcgtaatgcgccgcagttttgcatattggcacgcaacagctcgataaacggttcataggcacgcgcggtgatgatatgcgggtccattggcggcaatccccagttctgccccaacgggccgaggatatccggcggcgcgccaaccgacgctttcaggcaatacagttcacggtcgcaccaggtttctgccccaccttctgctacaccaacggccagatcacgatacaagccaatcggcatttcatagccctggcttatctcccagcaggcggcaaactggctgtaagccagccactgcaaccagagataaaaatcgacgtcatcacgatgttcttcgcagaactggcgcacttctggtgaatccacgttctgatacatctctggccatgctggccagccccagcgcatttcgtcctctttcacttgctgggcatgtagcgcatcaaaggctgcctgccagaacaggctgtcgccctgctctgcaacaaactggcgaaacgcggtcatctgctcatcatcacgttgcgcgaaacctttccacgccattcgtaatgctgtcatttttagggtggtaaccgtggagtaatcaacccagtcggcatcccgcgcctgttgcagcgtctgttgcgtggtcggcaactgccaccaggcctgagcctcttcgctaagatggaaatcttcaactgcgttaacgtcgatataaatcacattcagccaacggcgagaagacgggctgtacgggctggcactttccggatttgccagatagagcgcatgaatcgggttcagaccaataaacgacccgccacgttttgccacatccaccagcatcgctttgagatcgccaaaatccccaataccccagtttttttccgatcgcagcgtataaagctgaacgcaggcaccccacagcttttgtttattcagcaacgcctgcggttcgtaacagcgtttcggggcgacaatcacccggcaatgcgcgcgctggtcgtcttgggtaagcgtcagcgtgtaataaccttccggcagcttcgtcggtagattgaacgctttgccccccgttacatggcctttgtactgcgttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctaatacccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtatagcacatccacctgcttttgtgcctctacataggctgcgaaatccgccatcaccagatacggatcgccgccctgtttgccgatactgtgcagcatctggtcgaaggcatgcttatcgccgtcgctgtatttgccgctttccagctctttcaatactgcgtccagcaccttatctttcttccgccatttcaccgggtcgtagcctttggccagaattgccttcacttgttccacggtatgaccaaaaataaagatattttcttcaccaactttctcggcgatttcaacgttcgccccatccagcgtaccgacagtaagcgcaccattgagcgccagtttcatattgccggtaccggaagcttctttacctgccgtcgaaatttgttcggagatatccgccgccgggatcagtttttccgccgccgaaacgcaataatccggcaggaacaccaccttcaatttgtcgccaacctgcggatcgttgttgatcacgtcagccactttgttgatcgcaaagataatgtttttcgccaggtagtagcccggtgccgctttcgcgccaaagaggaagacgcgcggtacgcgatcagcctgcgggttttcacgaatttctttgtacaacgccagaatatgcagcagattcaggtgctggcgtttgtactcatgcagacgtttgatctgaatatcgaaaatcgcctgtggattgatctcaataccggtacgaactttcacaaactctgccagacggactttattcgcctgcttgatctcgcgatattgctgacggaatttcgcatcatcagcgaatttttccagattgatcagttgatcgagatcgttagtccactcttttttcagtgatttatccaacagagccgccagtgccgggttgcactgtttgatccagcgacgtggggtaataccgttggtgacgttatggaatttgttcggccatagctggtgatattccgggaacagatctttcaccaccagatctgagtgcagcgccgcaacaccgtttaccgcgaaaccgccaaccacacacaggttcgccatatgcacttgtttgtcgtgtaccaccgccagtttggcccacactttttcatcgcccggccaggttttttccaccagcgttttaaagcgagtattaatttcgttaataatctgcatgtggcgcggcagtaagcctttcaccagtttcacatcccagcgttccagcgcttctggcatcagggtatggttggtgtaagcgaaagttttgctggtgatggcccaggcgtcatcccagctcatctggtgctcatcgatcagcacgcgcagcagttctggaatggcgatagttgggtgggtatcgttcagctgaataacttcgtactccgccagttcgtgcagtttacgccccgccagatgatggcgacgcaaaatatccgctaccgaacaggcacactggaagtattgctgcatcaggcgcagctttttaccggcagtatggttgtcgtttggatagagaactttggtcagtttttccgcgttgataccctgctgttcggcgcgcaggaaatcaccatcgttaaatttagtcagatcaaacggatgcgcatgcgtcgcctgccacagacgcagtggctgcgccacgccattacgatagccgacaacggggagatcccacgcttgaccggtaatggtaaactccggctcccagcgtccatctttcgtcactttaccgccaatccctacctgcacatccagtgcttcgttgtggcggaaccacgggtagttaccgcgatgccagtcatccggcgcttcaacctgtttgccatcgacaaaagactggcggaacaaaccatattgatagttcagaccgtaacccgtcgcagactgaccgacagttgccattgagtcgagaaagcacgccgccagacgtcccagaccaccgttccccagcgccgggtcgatctcttcttccaacaggtcagtcaggttgatgtcataagccttcaacgaatcctgtacatcctgataccagccgagattcaacaggttgttgcccgtcaggcgaccaattaaaaactccattgagatgtagttaacatgtcgctgattcgccactggcttggcgaatggctgagcacgcagcatttcggccagtgcttcgctcactgccagccaccactggcgaggagtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcgaccacttaaagctagtgcaatccacaggattagcagcaaatcaatgccataccgcgcagaaaatctgtatctaagtgcaaaaaatggccgttgcgtattttcaaaaagcggaaggtaactctataaattaagtaaaggagtgaaacagtttcacaagtaaaatatcaaatgtgctccatctcattcttaatagatttattaagatcatctttttagatggcactttcatcagaaatgaagaagaaacccttacttaaatgaaactgatgaacataaggaaaataccgtacaacccagtattcacgctggatcagcgtcgttttaggtgagttgttaataaacatttggaattgtgacacagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaattaagtcgtccggttcgactcgaccataccgtggttcgtgagcgcctgctggctaaactttccggcgcgaacaacttccggctggcgctgatcacaagtcctgcgggctacggaaagaccacgctcatttcccagtgggcggcaggcaaaaacgatatcggctggtactcgctggatgaaggtgataaccagcaagagcgtttcgccagctatctcattgccgccgtgcaacaggcaaccaacggtcactgcgcgatatgtgagacgatggcgcaaaaacggcaatatgccagcctgacgtcactcttcgcccagcttttcattgagctggcggaatggcatagcccactttatctggtcatcgatgactatcatctgatcactaatcctgtgatccacgagtcaatgcgcttctttattcgccatcaaccagaaaatctcacccttgtggtgttgtcacgcaaccttccgcaactgggcattgccaatctgcgtgttcgtgaccagctgctggaaattggcagtcagcaactggcatttacccatcaggaagcgaagcagttttttgattgccgtctgtcatcgccgattgaagccgcagaaagcagtcggatttgtgatgatgtttccggttgggcgacggcactgcagctaatcgccctctccgcccggcagaatactcactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgcactcatcacccgtgtgaccggcgaagaaaacgggcaaatgcgcctcgaagagattgagcgtcaggggctgtttttacagcggatggatgataccggcgagtggttttgctatcacccactgtttggtaacttcctgcgccagcgctgccagtgggaactggcggcggagctgccggaaatccaccgtgccgccgcagaaagctggatggcccagggatttcccagcgaagcgattcatcatgcgctggcggcaggcgatgcgctgatgctgcgcgatattctgcttaatcacgcctggagtttgttcaaccatagcgaactgtcgctgctggaagagtcgcttaaggccctgccgtgggacagtttgctggaaaatccgcagttggtgttattgcaggcgtggctgatgcaaagccagcatcgctacggcgaagttaacaccctgctggcccgcgctgaacatgaaatcaaggacatcagagaaggcaccatgcacgcagaatttaacgctctgcgcgcccaggtggcgattaacgatggtagtccggatgaagcggaacggctggcaaaactggcactggaagagctgccgccaggctggttctatagccgcattgtggcaacctcggtgctgggtgaagtgttgcactgcaaaggcgaattgacccgctcactggcgttaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcgttccagctgatcaacgagcagcatctggaacagctgccaatgcatgagtttctggtgcgcattcgtgcgcagctgttgtgggcctgggcacggctggatgaagccgaagcgtcggcgcgcagcgggattgaagtcttgtcgtcttatcagccacagcaacagcttcagtgcctggcaatgttgattcaatgctcgctggcccgtggtgatttagataacgcccgtagccagctgaaccgtctggaaaacctgctggggaatggcaaatatcacagcgactggatctctaacgccaacaaagtccgggtgatttactggcaaatgaccggcgataaagccgccgctgccaactggttgcgtcatacggctaaaccggagtttgcgaacaaccacttcctgcaaggtcaatggcgcaacattgcccgcgcacaaatcttgctgggcgagtttgaatctgcggaaattgtcctcgaagaactcaatgaaaatgcccgcagtctgcggttgatgagcgatctcaaccgtaacctgttgctgcttaatcaactgtactggcaggccggacgtaaaagtgacgcccagcgtgtgttgctggacgcattaaaactggcgaatcgtaccggatttatcagtcattttgtcatcgaaggcgaagcgatggcgcaacaactgcgccagcttattcaactcaatacgctgccggagctggaacagcatcgcgcacagcgtattctgcgagaaatcaatcaacatcatcggcataaattcgcccatttcgatgagaatttcgttgaacgtctgctaaatcatccggaagtgccagagctgatccgcaccagcccgttgacccaacgtgaatggcaggtcctggggctgatttactccggttacagcaatgagcaaattgcaggcgagctggaagtggcggcaaccaccatcaagacgcatatccgcaatctgtaccaaaaactcggtgtcgcccaccgtcaggccgcggtacaacacgcgcagaaactgctgaagatgatgggatatggggtatgagtttagccggataatgcgccagatccggcttacatctttacatcattcaatgctcacccgcgttacgccatctgtttctatcaaaccaaaccgcaccggcaagaaacgctccaccacggcgatattggtcagcagatggcatgagggatgggcgaccgtaaattcccccgtacccgccagcgccatcggtagcaccagttggtcggcgagatattcccccaccgccgtcgggcttgccaggtagcgtttcacctctttcaccaactgtgccgcgaccacctcggcactgacgcgcttttcaccgacgacaaaaaagcgttcggtgatattttcactttcgacttcaagcgagacggtattacccggcccctggtcgcgcggtaggctatgaacagcctgttcatgaagtgaaaaacttgccgccagtgtagcgatttcacgctcagcgacatggcgcggcacgccagctaatagcacctctccacgcatctgcacaatgttcccgcgctcgccaagttgcaagctattaaacgatgccaccggtgagacttccgttgccaccacgccgcctccggcaggataaaaaccgtgacgtaacagcgtggtttgctgatgaactcctattttcgccagcagcggctccagcacccggcggataaaatccgcaggcggggccgacgggttatcggtgccgccgctcacttcaacacgcgaaggtccatcggcaaaccacagcgcgggcagcaccgtttgcagcaccagcgtacaacttccggcgctaccgatagcaaagcggtaatcgccgccgcgcacggtgccaggtcggaagaccagacgctgcgaccccagctcagcgccttccaccgttgccctacaaatttccgcagccgcttttaccgcagtcagatgttggcgcaacagccccggtttcgcccgcccggcacgaatgccggtgatggtaaatggctggccggttatcatcgacaggctcagcgccgagcgcaggatctgcccgccgccttcgccctgtgcgccatccagcgcaatcatccttttcatcatttatccttttacgcacaccacctgacgcagggtatagataacttccaccagatcgctttgtgccgccatcaccgcatcaatatctttatacgccatcgggatttcgtcgatcacctcggcatctttacggcactccacatgcgcggtggcacggatttgatcttccacactgaacagttttttcgctttagtacggctcattacccgcccggcaccgtggctgcacgaacagaacgactcttcatttcccagcccacggacgataaagcttttcgcccccatcgaaccgggaataattccatattgaccagcacgcgcagacaccgcgcctttacgcgtcacatagatctcttcgccaaagtgctgttctttttgcacatagttgtggtgacagttgatctcttccatcgccagcgtttgtggctgttttaccgttttctgcgtaacgctctgcaacgccgttaccacgttttccatcatcgcatcgcggttaaggctggcaaaaagctgcgcccaggccacggctttcaggtaatcatcaaagtattccgtaccttccataaagtacgccaggtcacgcgatggcaacgtttcaagcgtttcctgcatctctttttgcgccagatcgataaaataagttccgatggcgttaccaattccgcgtgaaccggagtgcagcataatccacacctgatccgactcatcaaggcaaatttcaataaagtggttacccgtacccagtgttcccaggtgtttatagttattagtgttaaggaaacgcggatatttttgcgttaaccactgataaccggcctccagctcagcccatttcgcatcgacgttaacaggcggattttcccatgcgcctttatcacgtttacaacgcccggtagtacgtccgtgcggtacggccgtttcaatcgcctgacgcagctctgccaggttttcaggcaggtccgccgccgttaacgcggtacgcagtgcgttcattccacagccaatatccacgcccaccgccgccggaataatcgcccctttggtcgggatcacgcaaccaatggtggaacctttacccaggtgtacatcaggcattaccgcaatatgtttgaaaataaacggcatcttcgcggtattaataagttgctgacgcgcatcggcttctaccggcacgcctttggtccacatttttaccggagcattttcagtggtcagtaattcgtaattcattttgtttttctcttttcgttgtttgctgtcctgataattgcaaccgtcgtgccagaaaatcaaataagcatcttaattttttaattcattgtttttaaaaatattatatttttacgtccgtaaacggagatttcccgcaaagccgatttaccgataatgaaatctcgtcttttataaggatatctaagatgcgtaaaacagtggcttttggctttgtcggaacggtgctggattatgccgggcgcggcagtcagcgctggtcaaaatggcgtccgacactctgtctatgccagcaagaatcgttagttatcgatcggctggaattattgcacgacgcccgctcgcgctcgctattcgaaacgcttaaacgcgatatcgccagcgtttcgccagaaacagaagtggtgggcgttgagatagaactgcataacccttgggatttcgaagaggtttacgcctacctgcatgatttcgcccgtggttacgcgttccagccagaaaaagaagactatttaattcacatcaccaccggtacccacgtcgcgcagatttgctggtttctgctggcagaagcgcgttacctgcccgcccggttgatacaatcttcaccaccgcgcaaaaaagagcggcccgatagccctggcgcagtgacgattatcgatctcgatttaagccgttataacgccatcgccagccgctttgccgaggaacgccagcaagcgcttgattttcttaagtccggcattgccacgcgtaactcccacttcaaccgcatgattgagcagattgaaaaagtggcgataaaatcccgcgcaccgatcctgcttaacggcccgaccggtgcaggtaagtcatttctggcacgacgcatcttcgagctaaaacaggcgcggcatcagtttagcggcgcgtttgtggaagtgaactgcgccaccctgcgcggcgataccgccatgtcgacgctgtttggtcatgtgaaaggcgcgtttaccggggcgcgggaatcgcgtgaaggattattacgcagcgccaacggcggaatgttgtttcttgatgagattggcgaactgggcgcagacgaacaggcaatgctgctgaaagccattgaagagaaaaccttttacccgtttggcagcgatcgccaggtgagcagtgattttcagcttatcgccggaacggtgcgcgatttgcgccagttggttgccgaaggcaaatttcgtgaagacctgtacgcgcgaataaatctctggaccttcaccttgccaggattacgccaacgccaggaagatattgaaccgaacctggattatgaagtggagcgccacgcctcactcactggcgacagcgtgcgttttaacaccgaagcgcggcgtgcctggctggcctttgcgacctctccccaggcaacatggcgcggtaactttcgcgaactttctgccagcgtcacgcggatggccacctttgccactagcggacgcatcacactggatacggtggaagatgagatcaaccgtctgcgctataactggcaggagagtcgcccctccacgcttacggcgttgctgggcgcagaggcagaaaacatcgatctcttcgaccgtatgcaactggaacacgttatcgctatctgccgccaggcaaagtcgctttctgctgccggacgtgaactgtttgacatttcgcgccagggtaaagccagcgtcaatgacgcggatcggctacgcaaatacctggcgcgttttggtctgacatgggaagcaatgcaggatcagcacagctccagttgaatatgatggtccttcagcacctgcatcacgctcgcaggcggcatcgtgtcggtgtagacagcatcgaccatgctgatgctacccatattgaccattgcgttacggccaaattttgagtggtcgacaaccagcataacgtggcgcgagttctcaatgatggcgcgtttggtgcgaacttcgtggtaatcgaactccagtagcgagccgtcgctatcgatgccgcttatccccagaatgccgaaatcaaggcggaactgggagataaaatcgagcgttgcttcgccaatgatcccgccatcgcggctgcgtaattcgccaccggcaagaatgatacggaaatcctcttttaccatcagcgtgttagcgacgttgagattgttggtcacaatgcgtaaattgctgtgattaagcagcgcgtgcgccaccgcttccggcgtggtgccgatatcgataaacagcgtcgagccattgggaatttgctccgccactttgcgggcgatgcgctctttttcttcggtctgggtggccttgcgatcgtgccacggcgtattaaccgaactggaaggcagcgccgcaccgccatgatggcgcaggatcaggttttgctctgccagctcgttgagatcgcggcgaatagtctgcgggctgacggagaagtgctccaccagctcctcggtactgacataaccctgctgtttaaccagttcgataataccgttgtgacgttgtgtttgtttcatttctaaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcagcgcaaagataattaacccacgttgcaggtaaatgccactttgcggatcgcgttcaccacgtagccagacgtagcccatcagcgcatacaccacgccagaaagcccgccaaaccacggcccgctgaatttttgctgcacatagccgcttaacagggcgctgataagcgtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaacttcagcgtcggatcgaatggccaggccagccataacatcacttcctgatcaccgagaatttgcatggcgataaacaccaccacgcaggcgatcatcatcacccaggtcaccggacctgcgcgttcacgcaaggcagcaaagaagggataacggcgataatgcaggccgctgccggtatggcccgcctgccagctggccgccagataacgcggatctgccgggttttcgagaaaacgcgccagctccgcccgcacgcgctcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactggcgctgccaggcttcaaagccgccatcaatgctatagaccacatcgtagccctgttgcagcagatactgcgccgcgcctttgctgctattaccgtggtaacacatcaccatgactggcgtatcgaagtcgttatcacgcataaacgcgcccaatgtgtcgttggttaaatggaaagcctgcgccgcatgccccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttacctcacagtttacgtcgaagcggcagataaacgccataatgttatacatatcactctaaaatgttttttcaatgttacccaaagcgcgattctttgctaatatgttcgataacgaacatttatgaactttaacgaaagtgaatgagggcagcatggaaaccaaagatctgattgtgataggtggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgactggtcagcgaggcgctggctgaacgtgaagtgctactgaaaatggccccgcatatcgccttcccgatgcgttttcgcctgccgcatcgtccgcatctacgcccggcgtggatgattcgcattggtctgtttatgtacgatcatctgggcaagcgcaccagcctgccgggatcaaccggtttgcgttttggcgcaaactcagtgttaaaaccggaaattaagcgcggattcgaatattctgactgttgggtagacgacgcccgtctggtactcgccaacgcccagatggtggtacgtaaaggcggtgaagtgcttactcgtactcgtgccacgtctgctcgccgcgaaaacggcctgtggattgtggaagcggaagatatcgataccggcaaaaaatatacatggcaggcgcgcggcctggttaatgctaccggcccgtgggtgaaacaatttttcgacgacgggatgcatctgccttcaccttatggcattcgcctgatcaaaggcagccatattgtggtgccgcgtgtgcatacccagaagcaagcctacattctgcaaaacgaagataaacgtattgtcttcgtgatcccgtggatggacgagttttccatcatcggcaccaccgatgtggaatacaaaggcgatccaaaagcagtgaagattgaagagagtgaaatcaattacctgttgaaagtgtataacacgcactttaaaaagcagttaagccgggacgatatcgtctggacctactccggcgtgcgtccgctatgtgatgatgagtccgactcgccgcaggccattacccgtgattacacccttgatatccatgatgaaaacggcaaagccccgctgctgtcggtattcggcggtaagctgaccacctaccgaaaactggcagaacatgcgctggaaaaactgacgccgtattatcagggcattggtccggcgtggacgaaagagagcgtgctgccgggtggtgccattgaaggcgaccgtgacgattacgccgcccgcctgcgccgccgttacccattcctgaccgaatcactggcacgtcactacgcgcgcacttacggcagcaacagcgaactgctgctcggcaatgcaggggcgataagcgacctcggtgaagatttcggtcatgagttctacgaagcggagctgaaatatctggtggatcacgaatgggtccgccgcgccgacgatgccctgtggcgtcgcacaaaacaaggcatgtggctgaatgcggaacaacaatctcgtgtgagtcagtggctggtggaatatacgcagcagaggttgtcgctggcgtcgtaaggatgatgcccggttgtgaagtgcaaccgggctatttgaattccttagactattcattgtgaataattgaataacggccccagagataaaatcgccaaacttaagcacgttacccaatcgccccacttcttcctatggcttctatttttgctacgccactgacaataatatcccaacgcaaaaccaagctgtgcactaatcgggccaacaaaatcagtccacggctgcggccaaaaaggggaaaaattcaggggaagccagacaaacgtcagaaagaaatttcggatattttccagcaacgctgatttctctggagaaatataaagaatgaagttcgagagaattaaccaaaaatagaccggagaaaagaccagccagcaatgtaacctgttttttaattcaggaggcgttctgcgggagaattgccaaccgatgccacacattacactgaaaaaaagtgcatattcaaccaataactcaagttgtaattcctgaagagaaatacgcacaaccaggagcggaaaggagaatattatttccgccagaaaagttaacgtgaatataagtacggctaaggcaataaccgtcggccataccaataatggtacgataacaaaaccgagaattacagggggaatataaagccggaatttaatcatttttattttcctggtgattcggatgatgcgtcatacatcgcgcataaacactcatcaatcatccagtcgtcttcccagacctgataatgtgtgccctgttcgggctgattaagcaggttctcaatcgcctgccgcgcacgttctttcaggatgaattgattgttgaaggcccaggcattgatttgggcggtaatggctttatcgtcatcatcctgctcaaaacgactattctgaatattctcttccctgttatgccacagcaaacatgccatcgatactgtgggttggtaaccgggtacagagatgatggcatcaagcaatggcgaaagagcgatatcggcacggaaaaacatttccagcttgtactgtaattcgacagcctcatccccgggtacccaatcagtcatatactggcaagcaaattgctgcaatatttcccgttcatcctcacgccagttttctttactggcaaggttgatacgccgtagagaaaatacttcgtgaatattgtcaaattgcccctgcgcaacaaactccagtaaacgaggcagaaaataacgaacctcatcgctgttttgcggatcaggtcctggactactattccaggcattgattaaggaataaggaatcgctcgcaacgatgtattccgtaatgctttttgttcctgttgactcagacaatattcacaacaaaccacaaattgcttcggcgccggataacgacgaaaaatatgatatatctgctcaattaatgcctgcatggcaggagtggggtgcataattaccccctcgcccgctgatcgcgtgtaaagggttgatagacaaaacgagcattcgccgcattcaggcgaataatggcactacgagagagggaaaagctgggccgaatgcaataattacagtcccaacagctttcctctgtgcaattttccactgagtaatgacgcgcgtagagtttcagttcagcctgcttatcgcgaaatccgcgtaaactgttaccgttttgaaattgccaggcttctttaaacacctgaaagatataaacatcctcaatccaggcgtcacattttttaagcggacgctttgctatgatcacccgctcatccgggttgagcatcgccgtaaattgtacggtgaagtcatttgtcgtgttcagatcacattgaacatctggtacatcactgatatagaggtcaaatccaaagtcagcaccacaggcacaaagacggctaatggtggcggtatcgagggaaaatcccggccatacattgctggacgttaaaccaatatttaatgtgacatcatatcgagataatccctcaagaccggcagcaccggcgaacttttccccttcatccaggacctggttaatgagttgctgaacaatgccttcatcccagtatgttgatttgctgttggcaatcgtaatatccacgccagtgaatggatcagtaccggagaggcttgcaaataacgtatcaactaattccatttttattatccagcttaatgcaacattttatccatcggcacataacctacattttccaccaggtttttcccctgtagaattaaaaatatttttttgttttgcattccgttcatccctattattgcattttattttgcggtgatggctaaaccgattctgtaccagctcaaaaattactgatattccactcgcaatatagccagtgcattataacgacctgccgctggcacttttccagttgtactaacaggtaaagtcaggaaagtaacatcagcagtttgtgcagaagcagcctggttttccaccaatctgaacggaacgcctactgatgttgccagggcatttaaatctacggagttttgctgactatccataatcataataccaacatcaggattatcttgagcctgaataatactttgtttcccattggtatcacgtgtggcggaaatgttaccgtcgaataccaacgtcattaccgcatctatatctttatttgtacaattaatcggaatagttgttgctacaggagtaacaccagcgggcttcgctccggcaccagcccggctcaattcactggcccacacatccggcatattaacagtaaaactcgtaccctcattaatagtgcaaccttgcggaacctgaatatccaggttactgatccaggcattaaataatggtactggcccatgttccgtttgccgctgactggcatacaatgaaactaaaagtacattattcagagagacatcagagatgatttttttatccaacctaattttaatatagccttctgttcctgaagaccagtaatctgctttacttctgtcagcaggataattagtactatagttctcgaatggtactgttttatctgtcatcgccccatttctattgtagagctttatatgtgttgaaatagatatttcatgcgtaacaggaataaatatctccgctccctgtggattacctgaagctcctgaaggatctattcctgaaatacctgaaaaataaacttcataatcatcaagagaattacagtatgctttatatcgacctattttccagttttgagatggtaaaacagtaccggctgaattgttgttaacatctgaaataataactgtaccaaaatcataaaaaaaggtcgctggggtagtattgttttctggagtcccaggatagcaaaattcacgatcccggcccatttcagcataggctacgacatggcaaactaagaataaaaaaattataaaaataattttcactttatatccggcataagtaatcatattatttccttttactaatccgttttaacttgtgaacctgacacatccatctgcaacagattcatatttactttccatgcaggcaatacattattataaatatccaatgtctgccatgctatttcacaaaccccttgcgatttacaccatgattgttggcgatggctaaatggtgcgaccataccaccatctataactttaccatcaacatgtaggttatagagtgtcacatatctggggcctggattataaacggtaacaatttcattttttcgtgcccagcgtaatttttgatatgacatattcgggtcttcagacaaatttgatggccgatagaatattttcatacgattgcggactgctatttgcaattgattatcagttttgactgaatgactattttccaacgttggtaatgctgcaacattcagtataaataaactttcccggtcggcaggtaaactgccaccaacacgattaattcttatttttgtatttttgtcaggcttcaaaacaaacagtggcggagttgcgataaataccgtttcagaatatgagggcaaagattcaaccgttcccgtcaactgacgagcatcatcaggggagacagcaaccttgactaacatatctctgtctgaagtgtttttgagttcaacagatattgaggactgattttccggatacgcaaaacgcgttccaccgatcactaagcctgcttgtgctgtagagaataaaagggaaaataatactatgactaccttaatcataggtgacaataaacgatactgacgcatttgcatcccctggttggacattattttttaatgctttgtaagccgcaaaaaaatgcaatatattatcaactgatgatgtaagtgaaaaacccatgcttttaacatcattactaatactgcctttgttcttatcaaaaatcgtaagtgcaagcccctctaccgagccatcttccagcttatataaactggcatcttcagaaactgtattgccggtaaactttatatacgcgttgccaacatcactaccacagcgggttaacgttatggaaaaataaaccttttcagtaacatcccctgcactccttaccgaactactgggtacatctggcatattaactgtaaaattttttgactcatcagaaataatgcaggttttttcggtaattaccccttcaatacgaaccactccggcatgagtgatatcatcagcaaaagaatttgttgatattataaacaaaaataaactaatgaatatcttcatatctccctcactgataatcgatatcaaaatacaacagagcatttgcttgcccggcatgtacattttcctgagttgatttatagcgaagtttaaacgtcaaattagcatcaccgttttcatttaacactaaatcacgaaaacctgattcaccattaatggcaatcgccacatcattgttatccaatatttctattcccagtccagtcgcactatctgcaccggcggagagacgcagtaatgcgctattaatagcatctgcatcaccagtaaaccgcacattggcgctcacaccagaactataaacagtactttttgcagtcgggcatccttgtacattaatcgtaaacgtttgactcggagaaacatcacctacatttaaaaattcattagcatcataagtgcccatttttaccgactgatctttacttccggtagtaatgtcacagctttttgccaacaaaatcccagtaaatgtaacaacaactgaatcattggcctgccctgagagcggaaaagcaaaaaaagcgaaaagaataaaaaatacagaatatttagagaatattaaattcattagcggcactccagagttgcatagctaacaggattatccagttctgtttcagggagcttgtaattagcctgacatttttgctgaacaccgtctccccactggatattaataacaccttctaaaggcaatcctgagagataaagttgtccattatcgccgacaatcccggtaatttgactactgtttttaatctgagcgctggctgtagcaccgaatgggactgatttattacgataacgaactgtgaacaaaccacgaataccgatatgagcagcaaactctgcacgaactaacgcaccttttcccggaataacttcagtggaagtgatatccagttcagtatgcatattcattgacataggatctaatgaaatattattacgtctatattctgttgcataaggaacaactgcatatccacgccagtcagtggatattcctgtcccccgctgaacatccacattattcgctccaggcgcttttatcaaaacattagtttcacctaatggttgactcaacgtaagaccattttcatgtacaacaagagcaccactgatgccatagtttatttgttgattaccttcattatcgtaactgtaggcggaattcaaggaaccatatgccccacgataattaacaccaacagaaccactactgctattatcctgattagcaaaaccatgttgtatgttataactgagattatgctgctccaacagagaaccagatacccccgtatattggtttacctgtccgtggttatcctgactataaccatacgttgcagtcatggcattcgatgatgagcgcccatcattcgtggaagataaccaattacttataggtaatgagacatttagcgagacaattttatccgcatttgtccctggtgatttactgtaattccacgcaacatttagatagatacccttaatactggtgttataaccaacttggtataaagaatcttttttatcagtattccagtatgtttgctgactagccgataaatacatagacccgtagttaccgaaaggttgcgatacactagcctgaaattttccacgtttgctataacgcaagttataaaaatcattccagttataaacgtaatctttatcatctaacgtttttggatcaacaacaatccctgacatttgttggtatgtcgtatcacttaaagtgtaaaagccctgggttgaataacgatagccaataatatggaatgctgttcctgtctgaactaacgatttggaataaagaaaacgataagattgcccttgatgtttgctcccatccacaagcgaactgttagcctgagtaacatcaaacgatgttgcaccaaatacacccagattcaggccaaggccgagcgccaacgcccggtaatcctcagagaattgtgccccaccataagccgtaatatcccagggtaaaccccaaattaattccccctgaaatacataaggacttttctggttatagctattgcttcgatattggccaaccgtagtagaatattttaaatgaccttctcgttgcaggatggggacagcggcataaggtacggtatagacagtttctgaattatcagactctttgatggtaacttccagatctcccgcagatgatgtcgggttaagatcgctaatctcaaacggtcccggcggcatataggtttgataaatgacataaccattctgtttgattgttacctgagcgcgacttttcgcaattccgcgcaccgtgggagcgaaaccactttgactatcgggcaacatattttcgtcagattccagttttatgccacgaatactaacactgtcgaaaacatctgatgatgaccatgtatctcctagcgttaattcacttctgaaaggaataataacgcgctgcaacgtactactgatatgctccagtttacctgctgaattactcccacgactccaggttgaataatcgcgaaaacgccatgcaccaatattgatcccagcgcgaagatttaaataatagttatttgaagagtaatcaccacgatcgttattaccagaaaagtcataattcagcaaaaaagctgtaataccgttatcccactgttctggtggaatatatccgcgagcgtcacgttttattatcgcctgtggaaaggtcagtttaagtctctgtgcatccagctccggcatgtaatgcacatcgggaaaccagatacgcaaatcaaggcaactattttcagatgaagccaaagcctgctctggcagcgcatttttgttaattccaaggcttaataagtcagcaagtgaaaggcagggaatcagttgattctcatcgtctgctttaaaagttacagtacgagagagtaaaggggaatcattgacccaaacttcgacttcatagctaccaggaagataagtcatccctttctcgaagcgggataagtcagcaacagcttcagtatcacccgacagaaaagcagggttaaagcgcattcccgcgattgaacatgcaggcataataaccagaagaagcggcacaacccgtttcatctgcttttgtgccgccatccaatattcgcatcttttgagctttaggttcatatccctgacctgtgttgcatctgaactattccgttgttactgcattattcctttctgccgctccgtcgtagcgccaaagtcattaattgtttgataagtaatttcaccagccaacgtcactggcgacgagaccgtaatatcacttttcggtggtacaaacatattgggcaatttactcccttgtactttaattcctgtcagtgtcaggtaataaggcgaaggattgataacttttagttgtttgccctcatacttaaaccgcaacatatttcgtgcttttcctggttgcacaggtagattttccgggcgataaaatagcttgattttgttttgtaatgccaactgtaaggtattcttctgtgtatttttctcatctgttggcggaattgctttaacattcatccaatacaaagtttcacgatcggtcggcaaattagtcttaccaagaaacatgatacgtaatgaagcttctttacgcgttggtaacataaagaggggaggagtgataacaaaatcctggctctttttttccgttttactgtcatcaacccatgattgaattaaataactggtgttgtcaccgctattttgcacactgagtgttatttgcttactttctgccggataaatcaatcgcgttacgccaaggccaaacccgcccgcggacgcattattaataaataatatcgatagtaaaaaaagaatccctgagcgtataatattttgtgatacttttaattcatccctgaatccataaacccattttttatttccaataatacatttcatacagcatccttgttgatgaaataacacctgttattcatactctattaaataatttcaatctcaggttacaactttttgtaacctgaaatcgtatttatatttactcgtacagcaccacaaaacttgctgttgacttaactacaccaggtgcaacagtgctaccgttttgagcataacctgcagtaaaggccgcgctgaaatcatgggtcgtagcatttcctggaattgtataagcggcggtggaggcgctaccctctgccgcagtagtattcaggttaatcagaccattattcgtcgtacctttggagtaaattcgaatccctacaccagtcgcccccgcattgccgctgttgtcagcatccgttgatccttctacttcgttagcgagcgttttattagcgctatctgcagtaccggtaaaacggaactcaattttctgatcctctgtattgctacattcggtcagattaatattgaaatcggtctggttgctcgccccctgtgcttctacgtcgataccagtgaaaaggttggaaggcacaaccggcaggacaacttcaatctgttttgaatcggttgcgaccttacaggtagctttcactacacggccagtaaagcggattttcccccccattgaatcaacgttgtcatccatatcagtgagcctgggataatcaacggtgctccagtcagtatccgccccaccaaattgtgttgcatcgccgggtgctgcggttaccgcagtagacatcagcatacctgatgccagtaatactgcggataaattagataaattgaatttcatttatacctttccttttgttaaaaaatccaagcaacattggtgtttttacattctgcgttaataagttatatctcacaaaaaaaataagctgacgttggctaattccagaaggttctttagaagagtaattgagtgaataatattatatatgctgcttagtaatgtacctaaaataatccaaagccgcaataagtgagtttatactcacatataacacactgataatgataaaatttatttttacgtggagttgtaagaggggcaataaaacataaatcacatgaataatattaatgcattcataataaattaatattatttgaaataacaaaataccaaaaacattatcatcaatcgttatttaatatatattaatggtatatattaaatagaataacatacatcaaagttattgtttattgtgtatagaaataccgtgagttccactctgtattacttcagcggaacacacggtatttagccgtatttgaacttacaatctcaccggatcaatatgccagatatgatcggcgtactctttgatcgtacggtcagaagagaagtagcccatattggcaatgttcagcatcgcttttgcggtccactcttcctgacgctcgtagagttcgtcgactttatcctgacaatcgacataactgcgataatccgccagtacctggtagtgatcgccgaagttgatcagcgaatcaaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaagataaagatattgtcagcaccgacatgatccagcatctcgacattcgcaccgtccagcgtaccgatagtcagcgcgccgttaagcgcaaacttcatgttactggtgccggaagcttccgtccccgccagcgaaatctgttcagacagatcggccgccggaatgatcaactgcgccaggctaacactgtagttcgggatgaacacgactttcagcttgtcgccaatctgcggatcgttgttgatcactttcgctacgtcattgatcaaatgaataatgtgcttcgccatgtaataggccgaagccgccttaccgccaaaaatattcacgcgcggtacccacttcgcatccgggtcggccttgatgcggttatagcgggtgatcacgtgcaacacattcatcaattgacgtttgtattcgtgaatacgtttgatttgcacatcgaacagcgctttcggatttaccaccacattcagctgctgggcgatatactccgccagacgctttttgttctccagcttcgcctgatgcaccgcgtgattaaccattgggaaatcacagtgttgttgcagatcattaagcaggctaaggtcggtgcgccagttgcggcccaggtgttcgtccaacacggctgaaagcgatgggttcgctaccgccagccagcgacgcggcgtcacaccgttggtgacgttggtgaaacgacccgggaagattttcgcaaagtcggcaaatagcgattgcaccatcaggttagagtgcagctccgatacaccgttaactttgtggctcaccacaaccgccagccaggccatacgcacacgacgaccgttggattcatcaatgatcgacgcccgtcccagcagatcggtatcgttcggatactgttcctgcaaggttttcaggaaatagtcgttgatttcaaagatgatctgcaggtgacgcggcagaattttacccagcatatcgactggccaggtttccagcgcctcgctcattagcgtgtggttggtgtaggagaagacctgacaacacacttcaaacgcgtcgtcccagctaaattggtgctcatcgatcagcagacgcatcatctcaggaatcgacagcaccggatgagtatcgttgaggtgaatcgcaattttatccgccaggttatcgtaggttttatgcaactgataatggcggcttaaaatgtcctgaatggtcgaggaaaccaggaagtattcctgacgcagtcgtagctcacgcccggagtaggtggagtcgtccggatacagtacgcgagatacgttctcggagtggtttttatcttccactgccgcgaagtagtcgccctggttgaatttaccgaggttaatttcgctactggcttgggcactccacaaacgcaacgtgttggtcgcgtcggtgtcgtaacctgggattatctgatcgtaagctactcccagaatctcttcggtttcaatccagcgcgtttttttaccttcctgctgaatgcgaccgccaaaacggactttatagcgcgtgttgtgacgtttgaattcccacgggttaccgtattccagccagtagtcaggcgactctttctggctaccgttaacgatgttctgcttgaacataccgtagtcatagcggatgccgtaaccgcgccccggcaaccctaacgtcgccagagaatcgaggaagcaagccgccagacggcccaggccaccgttaccgaggcccgggtcattttcttcatcaatcagctcttcgagatttaatcccatcgcttccagtgcgccctgtacatcttcgtaaattcctagcgacaacatggcgttggaaagcgtacggccaatcaaaaactccatcgacaggtagtaaacctgacgagtttcttgcgacaactgggcacggtttgagcgtaaccagcgctccacgagacgatcgcgcacagcaaataacgttgcgttcagccattcatgtttattggcgacgaccggatccttgccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgtcgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctggccggggtattccgctgccgccgcaaggaaaccttcctgcagcaccggatcgcccgcgccgagtagcgccagctgcccgccctgctccagaagaccaggtaaggcttccagcaccaggtcgagacctttctggctggtcagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctctggactccagattttctcgtccacgccgttcagtacgccggaaagacgcccttcacggtgacgctgttgcaacagaccttccataccgtaggcaaactgcggttcggtgatctcgcgagcgtaggttgggctgactgccgtaatgtgatcggcatagtacagaccggccttcaggaaagagatttgtccgttgaattccagcccatgaatattaaagaatgaccatggcaattggatgtcattcatgtgatgtgcataaaacatgccttgataggccaggttgtgcacagtaaacaccgacttcgccggacgcccgcgcgccgccagatacgcaggcgcaaggcctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtatatgccaaccccgttgtaatgaccgaacaacagcgtgatatgtccggcgaaggtatcacgacgggatactacctgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacaaccgccggataccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcgcgatcgtcttcttccagcagttcatacagatagtcggcgtcaaagacgtaaatacccatactcgccagagatttgctcggatcgttcggcattgacggcgggttagctggtttttcaacgaattcgataattttatcgttctcatcaaccgccataacgccaaacgcggaggcttcttcaatcggtactggcatacaagcaacggtgcaacgtgcgcctttttcgacgtggtcgataagcatacgcgagtagtcttgcttgtagatatggtcgcccgccaggatcaccacgtattccgctttataacggcggataatgtcgaggttttgggtgaccgcatctgcggtgccgcgataccagttttcccctttcattctctgctgtgctggcagcagatcgacaaactcgttcatttcttcattgaagaatgaccagccgcgctggatgtgctgcaccagagtgtgggactggtactgggtgatcacgcccatacgacggatcccggagttgatgcagttagacagcgcaaagtcgataatgcggaacttaccgccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcagatccctgccagacagccgtaatcactgggttatcctctccagcgaatgggggaatggcgtgccactccccagcaggtaaaacaatctctgttacctcaagcgtggcattaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccatcaaagcgggaatgcgcttgcgcagatggattaacgcggcggtaaatgcggttaaaccactgcttgcctgcgaccagtccaaccaggttaattggttatcctgacagtaggcattgttattgccatgctggctgtgaccatgttcgtcaccggccagtaacatcggcgtaccctgggagagcaacaacgttgttaacagggcgtgaatgctgtcgcgccgccgttcaaccagatcaagagtaccgcctaacccttctttaccatgattgttactgtaattgttgttggtcccgtcgcgattttcttctccgtttgcttcattgtgtttatggttgaagcaaacgcagtcgcgaagcgtaaaaccgtcatgcgcggtgacgagattaatcgcggcactcggcagacgatcattacgtttaaaaacatcgctggaggcagcaaaacgcccggcaaacgctcccagaggtaaatcataatgcagccagaaacgacgggctgcatcgcggaaatgatcgttccactcggcaaacagcggcgggaaatttcccacctgataaccaccaggagcgatatcccacggttcagcaattaacttcacctgcgagagcaccgggcagttctggatagcggtaaacaacggcgcatcctgacgaaactctggcgtacggcccatgactgccgccagatcaaagcggaaaccatcgacgtggcaggtttctacccaataacgcaggcaggcgctggcataatctaccaccgccggatgactcaaattgagcgtgttaccacaaccggtccagttgtgataatcgccgtcttctcttatccaataatagctacggttgtcgatcccacgcagcgagaataacgggccgtcgaggtccagttccgcactatggttgagcacgatatcaagaatgacttcgatacccgctttatgcagtgctttgattgcatcgcgaaactcatccagcgccgtttctggcgagcaggcatacgccggatgcagcgcaaacatcgccaccgggttgtacccccagtagttactaagccccatgcgttgcagacgtggttcgctggcaaattgtgccaccggcagcaactccagcgcagtaatgcccaactgtttcaaatagttgatcatcaccggatgccctagggctttataagtgccgcggatctcgaccgggatctccgggtgcagatacgttaatcctttgacatgggcttcataaatgatggtgctgccccacggcgtgcgcggcggggcatcatcttcccagtcatagtgatcaaccaccactacgcatttcggcgcaatggcggcgttgtcgcgatagtcaggttcattatgaccggcgtgcagcagcgggttatctttaaactccccgtcaatttgccgcgcgcaaggatcaatcaacaacttcgccgggttaaagcgatgcccctcggcaggttgccaggggccatgaacgcgataaccataacgcaaacccgggcgcgcatccggcagataaccgtgccaaatgtcgccactgtgccctggcaagtcatagcgatgttcctggccattggcatcaaagacacacagctctacccgctcggcatgagcggagaaaagtgtgaagttgacgccctgaccgtcgtaatgcgcgccgaggggagtgggtttgccaatggcgagttgtgtcattctgcctcccgaaccagccagatagtggccagaggtggtagcgtcaggctcagtgaatgctgacgaccgtggctggcaatctcatcgctgtgtactgcgccgccattgcctgcattactgccgtgatagtgcatggaatcggtattgaggatttcacgccatttacccggctggttaataccgaagcgataatcatgacgcggcaccggtgtaaagttactggcaacgatgatttcgttaccctctttatcgcgacgcacaaagatcagcaccgagcgttctttgtcatccaccaccagccattcaaagccgtacgggtcaaaatccagttcatgcattgctttatggtggcggtaggtgaggttcagatcgcgcaccagacgctggacaccgtggtgccagttatcgccgccttccaacagatgccagtcgaggctggcgtcatggttccactcgcggccctgggcaaattcgttccccatgaacagtagtttcttgcccgggaatgcccacatccagccgtagtaggcgcgcaggttagcgaatttctgccatgcgtcgcccggcatccggtcgagaatcgattttttaccgtggaccacttcatcatgcgacaacggcaggacgaagttttcagtgtagttgtagagcatcccgaaggtcagtttatcgtgatgatactgacgataaatcgggtcgagcttcatgtagtccagggtgtcatgcatccagccgaggttccacttgtaccagaagcccagaccgcccatatcctgcggacgagaaacgccagggaaatcggtagactcctccgccattgttactgcaccggaaacctgctcaccaagaatacggttggtattacgcaagaattcaatcgcttcaagattctcgcgaccgccaaattcgttcgggatccactccccctctttacggctgtagtcgcgataaatcattgacgccaccgcatcgacgcgcagtgcatcaataccaaaacgttcaatccagtaaagcgcgttaccgacaaggaagttactgacttcacggcgaccatagttgtagatcagcgtgttccagtcctgatgatagccttcgcgcggatcgctgtgttcatacaagttcgtgccatcaaattcggcaagcgcaaagtcatcggtcgggaagtggcctggcacccagtcgagaatcacgttcagaccagctgcgtgtgcggcatcaatgaaataacggaagtcgtcgcgagtaccaaaacggcgggtcggtgcatacaggccggttggctgataaccccaactgccatcgaagggatgctcgttaataggcagtagctcgagatgggtaaagcccatccatttagcataaggcaccagttgatcggccagctcgcggtagctcaaccagaaattgttgtcggtgtggcgacgccaggagccaaggtgaacttcataaatagagattggcgcatcaaactgattcgcttttttgcgctcttcagtctgcacaaccttttccggcaggccgcaaataagagacgcggtttccgggcgcatttgcgcttcgaaggcataagggtcggacttcaggcgcaagttgccattggcatcaatcatctcgtatttatagagctgaccgttatgcgccccggggataaacagttcccagattccgctctctttacgcagtcgcatcggatgacggcgaccgtcccagtagttgaattgcccaaccaccgagacccgacgggcgtttggagcccagacagaaaaacgcgtacctgtgacgccatccatagtatctgcatgcgcgcctaaggtttcatacggacgtaggtgagtaccttcagataatagccaggcatccatttcctggattagcgggccaaaacggtaaggatcatcaatcaggttttgctgaccatgccagacaacagccaactgatagcggaaaaaattcttacgtcgcggaatgacaccgctaaagaatccccgtgagtcgagacactccagttttgcgagtttgcgcccggttttcggttcaatcacccacacatcggtagcgtcgggtaaaagggcacggacttccagtcccgcggtggttttatgcatccccagtacggaaaaaggatccgcaaaatggcctgcaattagcgcgttaatcacgtctctatcgatacgatcggacatgcttgtcttcctgttttattgtgtcaccccatccaactgaatttttgacttctggttgtgacatttttttgacctgaacggcgcagcactctgtgcatcctctctgcgtcgtcctcacttcaggtaaggctgtgaatactcgtgtattccgccacccttaaagaatagccaatgctctatttaactcccggtaaatcatgaaacatctgcgcttactcctgtattacgcactagcaggggcggcatcgcgccccagatttaatgaataaagattacgccagttgacgaagcatccgacgcagcggctccgcggccccccacagcagctggtcgcccacggtaaaggctgacaggaactccggtcccatattcagcttacgcaggcggcctaccggcgtggtcagcgtgccggtaacggcagctggggttagctcacgcatagtgatttcccgatcgttcggaacaactttcgcccacggattgtgcgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcaagctgtttgtcgatccacggaatcaggctacccgccagcggcacgccaaagttatctaccggcagctcaccgctacgggttaaggttgtgactttgcgttcgatatcgagaatagcagaagacgggttcgcgagttcatctgccacatggccatacagatggcccatttgggttaataactcacgcatatgtcgcgcaccaccgccggaagcggcctggtaggttgcaacggacacccaatcaacaagatcattggcgaataaaccacccagcgacatcaacatcaggcttacggtacagttaccgccaacaaaagtcctgataccattatttaatccgtcggtaatgacgtcctgattgacggggtcaagaatgatgatggcgtcatctttcatgcgcagagatgatgctgcgtcaatccagtaaccttgccatccgctttcacgaagctttggatagatttcgttggtataatcgccgccctgacaggtcacaatgatatcgagggcctttagcgcctccagatcaaaggcatcctgaagtgtgccagtggttccgccaaaagacggcgcagcctgaccaagctgagaagtagaaaagaagacagggcgaatggcgtcgaagtcgcgctcttcaaccatgcgttgcatgagaacggagccgaccataccgcgccagccgataaaaccaacatttttcataagcgttttttcctgcaaagatgtgtgctgtataaatgtgccggtctcctcctggcacatctttcaccatacaaaaagcagccaaagtcgcaagtgaaattaatcaatgatagcgaagccatcagtaatgcgacttatcctgctttgttagcacgcagaaagtccgcggcaattatcagggaatttgagttatgaatgaaatcatttctgcagcagttttattgatcctgattatggatccgctcggaaacctacctattttcatgtccgtactgaaacatactgaaccgaaaagacggcgggcaatcatggtgcgagagttgcttattgctctccttgtgatgctggtgttcctgtttgcgggcgagaaaattctggcatttcttagcctgcgggcagaaaccgtctccatttctggcggcatcattctgtttctgatcgccattaagatgattttccccagcgcttcaggaaatagcagcgggcttccggcaggtgaagagccatttatcgtgccgttggcaattccgctggtcgccgggccgactattctcgccacgctgatgttgttgtctcatcagtacccgaatcagatgggacatctggtaattgctctgctactggcctggggcggcacctttgtcatcctgctacagtcttcgctatttttacgtctgctaggcgagaaaggggtgaacgcacttgaacgcctgatgggattgattctggtgatgatggcaactcagatgttcctcgacggcattcgaatgtggatgaaggggtaaggttcaaacaggtgttgcacacaaccagacgcggcacctgttttattacctgaactgataatgaccttcgcccaatcggataacccttccctcttcttctgcgcggttcagccacacactaatttgttcgatggttaaaccagtacaagacgccagcctttcaatacttatcgattcctttgcaaggatcgccagttccgccacaaagagttgataaaaatcgacaggggtatgcgcgggcattactgcgtaatttgcgtcatcttcgtgcagcgaaaacagttctggttgagcgttacggagtgctctgtcatacatcagcccaggaacgtctggcagtctgatcgtcacattctcagcctgttcagcactccatgacgccccattttctactaatcgtgaattggctgattgcatatcctgatttggtttaacctgcataggcagccactgatgttttaatgcctccatcgccccggttatcgttccaccggtcattcccgcacgtacaaccattgcgctttcagcaaggcaataaatatatttattccgcgccatcgcattgccgacggtgaaacgtacctctgggtaaaacggcgaaatcaacaccaggttgcctgctataagcccgtcacgccatttcactaacgtactcgtttttaacaagctatcagctaatacgccaacggcagttcccccgacctccagagccgaggccattgcacattcatcaatacctcgcgcaccaccagagataacgcaaatcccctgttgggccagtttcgcggccagttgttgggtatagcgcaaatcatcagtcggagcatctcgcgagccaacaatcgccataccttccgcttgcagtaatgctttattcccgcagccaaataaaacgggaggtgcatccgttcgcaatcggtttttcaagcgaacgggataatcggcatctccgcgggttaagatccataaaccggcgcgttgccacttatctaccgccaacgccagactatgaccacgcgccagcaagccaagaatacgctcctgagaaatacgcggatcgctccagcctgtaagtttctcttgcggttgcggcaccagaagctcggcgggactgatacgttggtgcttcagccataatgcaaacttcccccattcactattactaagaggtttatactcactcgccgccgcgcgagaaaaatcgctggttagcaggagagttgcttgtgcattggctgaaagattcatcaattttttaccgaggtagaagcaagggcaagaggataaaccgtcgggcaacctgcctggcgtaacagtgctgtcagaactgtcagcgtccatgcagaatccacgatatcatcaaccagcaacgccggacctggcatcaaaggaggggtaatcacaaacgccccgtcgagattttgacactggtgaaaacggttttgctgcattttctgcggtggattgtccacgactttttcaatggcatcaataaaaggtaagccaagtttcgccgccagtcgccgggcaaaatcaggaaccaggtcgaggtgccttaatgaaggaacgcagcatacccaggtgggttcaggatgcggattccagcgttggcgaaccatttccgcacatgcctccaccagctcatcactgaagcgccccgtttttttctcctgggctacctgctttccccacccggaatctccccaacgagaaaggattcgccccgtagatccttgtaaacccgcaggcaagttccctttaaatccgtattgcgtaaaagccccagatgccacctgtttattgagatttaatggcaggtcagcgtgtttaataaataaatttgccgcatggagtaagccgctatcaatgtcgggcgacaacagcggatgctgaagacaactgctacatttaccacaacgttcggcacttggctcatcgagtgcgcggcgcagaaattgcattttgcactctttggtcgtgatatagctttcaacgtctgccaactcactttttctctgattcatcaaatggttaattcgttcatgatcaggagaaaaactgacgatagttctgcgccataatttctcggtatacaccacaggcgatggattttcagctaccaataatttcagtgctttttctatttgcccataacgaagattcgtccgttgttcaatgcctcgtagggtaagaccgtcattctcgctaagtacgttgagtatttcatgaatttgcgcctccgcaggaaaggcgctttcacggaagaattgatgaatagcgcggtcttcaccaccacaaagcaatatgccaactgcggaatctatagcacgcccggcacgccccacctgttggtagtaaccgacaatagaccccggcatctgataatgaatgacgaaacctaaatcaggtttatcaaatcccatacctaatgccgtcgtcgcgaccagcactttgattttatttgccagcagtgcctgctccagatactccctggcagtattagaatcttccgcacctccacaagtcacgccgctgtaataagcaaatgcactgataccatttttccttaaccagtcggcgacaagttcagcatcgcgagtcgtcagggtataaacaattcccgatttggaaaactgagggataaccgttgctaaccatgccagacgggatgactgttctcctaagactaaggcatcaagcgccaaactttcgcgagccagcgttccacgctgaatcacaatgtcacccaattgctgacggatatcctcaacgacacggttattcgctgtcgcggttgtacccagaataggggtattcgcaggcagttggcgcaaaatatctaatatacgtcggtaatccgggcggaaatcgtggccccaatcagagatgcagtgcgcctcatcgaccaccagtaaaccgatgcggtcagcgactggatataaaaccgtttcaagaaaatcctgattcgccaaccgttcaggtgaaatcagcagacaatctacgccaccttgcagcaacttatcgctaatgcgctgccattcttccctgtttgtagaattcaacgtttcagccgtaatacctaaccgttcagcggcggcaacctggttacgcatcagggcaagcaaaggagagatgataattgtcgggccagcgccgcgatcgcggaagattttactggcgatgaagtacacggcacttttcccccagccggtgcgctgtacaaccagtagttttcgccgctgattaaccaccgcatctatagcttcccattgcccttccctgaaagtagcgctggtgttacttaacatccgctgtaacagcaattcagctccgtgtttctccatcatcttctccctcgtccgttaacgcagtgattagaacggataatgttccggtctttttgcgagagagatcaaaaagatgaagacaggagaaaagagaaatgaattactgcgagcaagctcgcagtaatttgtcgcagtaattaactcaacagctggaacgcaatcatcccaacgatggcaccgacagtgccgaggatggtttccatcatggtccaggttttaagcgtttcggcttcggtcgcgccggtaaatttaccgaacaaccagaaacccgcgtcgttaacgtggctgacaacaatcgaaccaccggcgatacaaatcgacagcgccgccatttgcgcaccagagtagttcagttgttcaatgaccggcattaccaatcccaccgccgttaaacaggcaacggtggcagaaccctgaatgatgcgcactgcagctgccagcacgaagcaggtgatggcaatcggcaggcccatgccggttaacgcttcgcccagtgccggaccgacaccagagtcaaccagcacctgtttgaacacgccgcccgcaccaatcaccagcagaatgatccccgccggttgcagcgcgtgaccgcaaatctccatcactttgtcttttggcataccctgacgcattgccagaccgtaaatcgccaccaggcaagcaaccagaatcgcggtaaacggatggccaataaactcgaaccattcgtaagcagtagagccttctggcacaaaacgcgcggcaatggttttcagccccaccagcaccagtggcaacaggatcagcgacaggctgaatccgaaggacggcattttgccttcgccgagatgcggttcgctgatgtcgtcaggaatatgcaactccacgtagcggctgatgaaattaccccacagcggcccggcaataatcattcccggaattgccgcgcacaggccaatcaggatcatccagccaaagtcggcgttcatctgcgatgccagcagcattggcgctggcccaggcaccaggaacgcagccgctgccgccacgcctgcaaataatgggattaccagcttcaccaggttcgtgccggtgtggcgcgccattgagaaagcaacgctaatcagcagaacaatcgccacttcaaagaacagcggtagcgcacaaaccagccccgcaaggccgatggcataatgcacgcggctgtgaccgaaggatttgagcattttgacggcaatctgatcgaccgcgccggtttcatgtaagatcttaccaaacatggctcccagggcgacaaccaccgccaggaagccgagggtgcctcccatccctttttccatcgtcgctgcgattttatcgagcggcataccggaaaaaaggccagcccccatggacaccaccattaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcaatatccaccaccagtacatcggtttcgtccgcacccggctcctgcagcgtttcaaactgcgtcaccagcatttgggttttaaagaaatggcctttgcgcgctttcaggcggctttcaatcacatcaaaatcgcctttcaggtagatgaaagagagattaggattaccttcacgcagcaagtcgcgatagtgttttttcagtgcagaacagacgatcagcgatactttattggtgcgctgcatagcaaacgcggcgtcgttcagcgcctgcaaccacggtttgcgatcgtcgtcattcagcggttcgccagacgccattttttcgatattgcagcgcggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaattaaaaatgttacgggtaactgttatcggtaacattgtccagccggacaatatcagaagcaatatccatccgtgccttaagtgtataagtgtgagctacttcaaatttgtaggcttaaatagatccgcccggtgacaaggtgaaacctaaatctaacattttcggtgtcacagattcgccacgaatacgcgccagcaggcgctcagcgccaatgctgcccatccgctcacgcggcgtcagcacactcgccagccgtggctccatcacctgaccaatgtcatgaccatggaaaccggcaatcgccatatcgtcaggaactttcaaccccagacgctgacattcaaacgccgcgccgaccgccaggtcatcattagtacagaacacgccatccagctgcggatattcccgccgcgcctggcgaatcagttcaataccggaagagtaagaagaagattgctcaaccatcacgctatacggcaccaggcctgcatccagcatcgcctgttcgtatcccttctgtttgatgatagtacgttcgtcgaggcgtgcgccgagataggcaatgtgacgatgcccgcgagcaataatggcggtggtcatctggcgtgccgcttcaaagttatcaaaaccgacggcgatatcgaggcacggcgacttactgtccatcaactccaccaccggaatccccgccacttcaatcatctttaaggtacgcggcgtgtgggtacgttcggtgaggatcaggccgtcgatattccatgagagcattgattcgaggcgttcttgctccatttccggtttataaccgtagtgcgccagcatggtttgataaccgtgcgcgtcggtgacgctttcgattccgcgtaatacttccgcgaaaacctggttggtgagagaaggtaacaggacgccaatcgcccggctggtggcgttagagagtatatcgggcgcgcgattgggaatataacccagttcatcaagagcggcggcaatcttgccgcgtagagcgacggaaacctgctccgggttgcgtaaaaaacggctgaccgtcattttggtcacgcctacacggtcagccacatcctgaagtacgggtcttttctttttcatcgtcctgaaggtacaaaagagatagattctcttagtttaacacggacgcatcagaaccttcccgattcctcaggaaggtttgtgagataaatttagactggcggtaaatcgaacagcaggatttcactgtcgctatcagcatggatggaaatcgcctgctcatcccagattgccagaccatcgctggtcgaggctttcacgccgttaatggtgacattgcctttcaccacctggatccagacgcggcgttcagcggcaatctgatgcaccgactgctcatctttcaccagcgcccaacgatacagttccatatcctgatgcactttcaatgaaccatcacgcgcatccggcgaaagcaccagttgtttgccctgcacggcatcgaagcgacgctgttcataacgcggcgtaatgccgttttcttcaggcatgatccagatctgatacagatgcagacgctcggtgctgcttgggttgtactctgagtgacgaatacccgtacccgcactcataatctggaactcgcccgccggaacctgctctttattgcccatgctgtcctgatgctcaacagtaccttccagcacgtaggtcaaaatttccatatctttatgcgggtgagtgccgaagccctgccctgcttcaatcacgtcgtcgttaatcacgcgcagcgcagagaagcccataaaattcggatcgtaatagttggcaaaagagaaagtatgccaggagtccagccagccatgatttgcatgaccgcgttcatttgctttgcgtaagtagatcatttgtattcgccccctgaatgatttcgatgggcttagtgtggacccgatccgcctgggatgatagagggtgaaaattgacccctctgttcaaaaaaattgaactattcgaggggccatcaaacttacctcgcgagagtcactgcggagggagaagcttgctcaaaaccgcgttcaaggatttccagattcgtaagaacttcagattccttgacgtaatttggcgcaccgttggtgatggtttgatacaacgcatcataaacgcgcccataatcgcccatctctggcttcatctcttctcttaccgtcacgccctcgtcattgacatactccagcacaccgaccgaatcatccgctgcgaatcctggttcgcccggcataatattagccttcaggctggtttcctgctggtcgataccgtatttaataaacgaacctttcttaccgtgaacgataaatttcggataatcgattttcaccagatggctggttttgacgatggcttttagatcgccataaaacagctgcgcttcaaaggtgtcgtccggattggctttattacgcaggctgcggatgtcataagcgacgtgatccgggcgaccgaacagagaaataatctggtccatcgtatgcacaccaaggccatagaacgcgccatcctgcggcagccccggtttggtttctgccaccgggcggtaatagtcaaaatggctttccacttcgacaatctctcccagcttgccgctttcaatcgcttttttcgctgtcaggaagcaggaatcaaagcgacgattctgatacggcgtaacgatcagccctttgcttttcgccagtgcaaacagctctttcgcctgcgcaattgtcggagtgaacggtttttcgaccagcacatttttcccggcttccagcgcgcgcttcgcgtactcgaagtggctgtccgcgtgggtgcagacgacaaccagcttaacatcgggatcgtttagcacttcgtcgagatcgctggtgaaatggatatgggaataaatgggggcctgttcttccggcttcgcatggcggcgaaaaatatgcgcgacatgccagctatccttgcggttaagtacatacggcagatggtaacgggtggtgcttttgccgaagccaataaaggcgcagttaatgaccatgatttcgtcctttttaaggtggttatttacaccttagcgcaaagcggacgtggttcctactggagtgcgcataacgaacacaagcacttcccgaggataaattgagaacgaaaggtcaaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaatgcatttgactcgcatttgaaagtcaatgatgttgaaagggacatttaccccaaagaggacaaaggaatgagtgagatagtaatacgccacgcagaaacacgcgattacgaggccatcaggcagattcacgcccagccggaggtgtattacaacacgctacaggtgcctcatccttcagaacaaatgtggctggaacgactcaccgctcgccctggcatcaagcagttagtcgcctgtattgatggaatcgtcgtaggccatctcaccattgacgtgcaacaacgcccacgccgcagtcatgttgccgattttggtatctgtgtcgactcccgttggaagaaccgcggcgtcgccagcgccctgatgcgagagatgattgaaatgtgcgacaactggttgcgggtagatcgtattgaactaacggtgttcgtcgataacgcgccagcaattaaggtctataaaaaattcggctttgagattgaagggactggcaaaaagtacgcattacgtaatggtgaatatgtcgatgcgtattatatggcgcgggtgaagtaagatagtgccctttttctgagatggaaaaagggtgtcattcaaaatcggcataccttcctttaatgtatttattttcccaataaatatatgagatttacctcataattacttcctaaagtgtaatattttattttttaatatatacgcctacaatttcctggagtaaataaataacaattaacaagcataatattgccattgataaaatagcatgccataaaaggacttttcagggatgagtaatattgtttatctgacagtaacgggagaacaacaaggaagcatctccgcaggttgtgggactactgaatctataggtaatcgctggcagagcgggcatgaggatgaaatatttacattctcactcttaaatagtattactaatacggggcttggttcacagttccatggtataacattttgtaaattaattgataaaagcactccattatttattaattccattaacaataatgaacaattatttatggaatttgacttctatcgaataaatagatttggtagatgggaaaagtattattatatacaactaagaggcgcttttttatcggctattcatcaccagatctttgaaaaccaactggatacagaaacaataactgttagttatgaatttatcctctgccaacatcttatcactaacaccgagttcagctatttggcactccctgaaaattataaccgcttgtttttaccaaattcaaaaaacaaaacaaataatggtttaaaaacgttaaacagcgaagctgttggcaggctacttgctgctggtggcgtatacaatgggaacattgaaggattcagagatactgcggaaaaactgggtggagatgcaatcaaaggctatgatcaaatactaaatgaaaaaacagcgggcatagcgatagcaacagcatctattcttttaacaaagcgttctaatgttgatacatatacagaaataaatagttacttaggcaaacttagaggccaacaaaaacttcttgatagtatagacataatagaaataatatacattaagagaccttcaaaagacttagctaacttacgaaaggagtttaataaaaatgtaagaaaaaattttcttatcaaacttgcaaaaacctccgaagcatctggaagattcaacgccgaagaccttttaagaatgagaaagggcaatgttcctctaaattataatgtacaccataaactatctctagatgatggtggtactaatgatttggaaaatttagcattaatcgaaaacgaaccatatcataaggtttttactaacatgcaatcacgaatagctaagggaatattagtgggtgaaagcaaaatcactccctgggccattccatctggctcaatttatcctcccatgaaaaatattatggaacccacaaatgatgactaaaacccaaataaataaattaaaaaaaatgatgaatgatttagactatccatttgaagcaccgctcaaggaatcatttattgaaagtataatccaaataaaattcaattctaactcaactaattgcctggagaagttatgtaatgaagttagtattctctttaataatcaacctgattatcttacttttttaagagcaatggatggattcgaagttaatggattacgattatttagcctctcgattccagaaccttcagttaaaaacctttttgccgtaaatgaattttatagagataatgatgatttcataaatcctgacttacaagaacggttagtgatcggggatgatagcatttcaatatttacttatgacattaaaagtaacttttttgaaattagagataatattggcacagaaaatatattcagttcgtttagtgatttctcttcattcttaaacgaaatcatggacagttgttcataataataaaaaggtaaccaaaatcattgtaaaccatgccatctttttagagtttaccagcagtaaatttcttgatcgaaatttatcaatacaagctatagaaaaacttacaacggaactacactccttaagtgagatggaccgaagacatgtagtcgctatttaaactgaaatagctaatggcgatgatgatcttagtgacatgttgatttggttagaattttacccgaatcataagattctgatatcttaaatgagcaaatccggttcgacgttctggaaaataaatcacaaaatattagcagatacttattttgtgactataccttatccgatgaactcttttcaaaaccagcatttaataatatctttgacgaagatgaacgcgtctttgctcaatgtataacgcaggaataataatataacgctaaacaataatatttattataattatgattacttatcacgacgcattcgcgaaagcgaacaattaccttgatgatgcaaatctcccggtcgtcattactctacatggacgctttagccagggctggtatttctgtttcgaagcacgagaatttctcgaaactggagatgaggccgcgcgcttagctggtaacgcaccttttattgttgataaaggcagtggtgaaattcattctctgggaacggcaaagccactggaagaatatctacaggattatgaaataaaaaaggctaccttcggcttgccctgacaatacggccctcttcccactaagagggccgctaaccttaataccccgccgttaaatcatccaccgagcgcgggtcggatgcaccgtacagctcaccgtccggcccaatcataatgctttgtgtactgcccatcgcctctttcagcgccactttctgaccttttgcttccagcagcttgatcgtatccgggctaaaccctttttcgacacgcagctcgtccggcaaccactgatggtggaaacgcggcgcattggtcgcttcggcgacgttcattccataatcgatgctattcaccaccatttgcagcacagtggtgataatccggctaccgcctgggcttccggtgaccagccaggttttaccatccttgaccacaatggttggtgacatcgacgacagcgggcgtttattcggcccgacggcgttggcatcaccgcccaccagcccgtaaacgttcggtacgcctggtttgtcggagaaatcatccatttggttattaagcagaataccgctctcgcccgcgacaatgcccgtaccgaaggtggtattcagcgtataggtcaccgccacggcgttaccgtctttatccactactgagtaatgggtagtttgattactctcataaggcgcaagcttgccaggacgaatttcgctggatggcttcgctttattgatatcgatttgatcggcaatagatttggcataggctttattggtcagcgcctgccacggtactttgacaaaatccgggtcgccaagatattccgagcggtcggcataggcgtatttctcagcttctgccatgatttgcatcgcgtcggcactgccaaagccgtacttctgcatatcgaagttttccagaatattgaggatttgtacgatatgaataccgccggaagatggcggtggcatggagtaaacctgatacccgcgataatcgccgcttatcggtgtgcgttcgaccgctttatataccgctaaatcttctttgctgatcaagccaccgtttttctgcatctcctgggcaatctgttccgctatcgtgcctttgtagaattcatccgggccgttttcggcaatcatctccaggctctttgccaggttcgcctgcaccagcttgtcgccctttttcagcggttcgccctctttccagaagatagctttgctgttttcgtggttcggcagcacttcactgccgtaggttttgagatcgtcagccagcgcgtcgttaacgataaaaccatcgcgtgccagtttaaacgccggttgcaccactttattcaacggcatggtgccgtatttatccagcgccaacgagaaacccgctaccgtaccgggtgtgccggaagccagatgcgaagtgagtgattttttgctgtccgggttgccctgatcatcgaggaacatatcgcgggtcgctttggcgggtgccatttcgcggaaatcgatagccgtggtattgccatttttcgagcggatcagcataaaaccaccgccgcccagattccctgcctgcggatgcgttactgccagcgcgtagcccaccgccacggcggcatcaacggcattcccgccctccttgaggatatccacccccacctgagtggcagtagcatctacagacgccaccattccctgcttagcgcgtaccggatgaaagacatcttcctccacaccataagaaacaggtggcgcggctaccgtactaaaacaacttcctgtgagcagagcagcaatggccacccggcgtaaaaacgtcggttttatcatcgttattctccagagattaaggggcaaccccagctaagcctggtatataactctgaattaatcatcgttttgccgggaagcgagtaaacttaaagaatatcttcagaggaggatacgcgatgaaacgacttctgcttttgacggcactcctgccgtttgtcggctttgcacagcccattaatactctgaacaaccctaaccagccgggatatcagatccccagccagcagcggatgcaaactcaaatgcagacgcagcaaatccagcaaaaagggatgctgaaccagcaactgaaaacgcaaacgcagctgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatatgctgccggagaggagaaacggcgacatgctgaatcagcccagcacgccgcagcctgacattccgttgaaaactattgggccgtaaagttcggaccaatcacgtcaatcgcatcggtacagatgcaatccacgccccagcgcagcaactctgccgcgcgctggggtttattgacggtataaaccagaatccgtaatccggcatctttcaactgcatcactcgcgctttatcgagcaacttatgattgagatgaatagagacgcagcccagtcgcgcggtcaattctcgccagtcgtcgcgccattcatcaagcaataaaccacgcggcagttccggtgctgcctgttgcgcggcttctaaagcatcaatctcaaacgatgacagcagcggcggcgtcataccggtccacagttcgcgtgccgccaacgccaccgttttgcccgttaatggtccagtgccagtggtgggtttgatttcgatattcgccatcatcccgtgttcgcggcagcgttccgccacctgcgaaagcaacggcagcggctcacctttaaacgctttgctgtaccaactgcctgcatccacgcgcagtaaatcctgccagttcagctcgcccgcaacgccccaaccgttgctggtacgttcgagattgtcgtcatggagcaggaagatctcgccatctttcgataactttgcgtcaaattcgatcatcttatgaccgtatcttgccccgacgtcgattgccgccagagtgttttccggggccagcttaccgccaccacgatgggcgacgatgcggggataaggccagttactcatactcgttgtcctgtttcaccatcaaaaagatgcagctgattttccggcagatgcagccacagcgtgctgcctgccgtcgggcgctcctgatgcgccagtcgcaccaccagcttctgttcgccccagcgtccgtgcgccaggttatctgcgccgaggatctccagcgtgtccatcaccagcggcacaccaccttctgcccgcgagcttagcgctatatgttccgggcgaatgccgagggtcattttacgcccggcatactgacggtagccaccgtttagcagcagcgtaataccaccatccagttcgaaatgcgtaccttcgttattcacgcggccagccagtaggttcatcgccgggctgccgataaaactcgccacaaacaggctggcgggcttttcgtacacttcaactggcgtgccaatctgttcggcgacgccgccgttcatcaccattactcgctgggcgagcgtcatcgcctcaacctgatcgtgggtaacgtagagtgaagtcgttttcaggcgacggtgcagctgttgcagttcaagacgcatctgcacacgcaacttggcatcgaggttagagagcggctcatcaaacaggaatactgccggctcacgcacaatcgcacgccccatcgccacacgctgacgctgaccgccggatagctcacgcgggcggcgcttaagcaggccgtccagctccagaatgcgcgccgcttctttaacacgttcggcaatttgttgcttgcccatgccgcgaattttcagcccccacgccatgttctcctctacgctcatatgcggatagagcgcgtagttctggaacaccatcgcaatcccgcgatctttcggctccatttcggtgacacgcttgcggtcgatccagatatcgcccgtcgttacccgctccagtccggcaaccattcgcaataacgtcgatttcccgcagccagacggcccgaccatcacgataaattcgccatccgccacatcaagggtcagcggtttaatgacctgggttttgccatcccagcttttggttactgcctgtaatttcagtcctgccatcttatttctcactatcgaccaggccgcgcacgaaggcacgctgcatcactaaaacaatcactactggtgggatcagggttaacaacatcgccgccatcaccgagttccattccgttgtgccttcgcctgtggcgatcatccctttaatccctgccacggtggtgccgagatcaacgtcggtaataatcaacaacggccacaaatactggttccagccgtaaataaaggtaatcacaaacagcgccgccagattggttttggacagcggaaaaacgatgtcgcaaaagaaacgcattggcgacgcgccgtcgatccgcgcggcttccaccagttcatccggtagggtcataaagaactggcgaaacagaaacgtggcggtcgccgaggccatcagcggcagcgttaaacctgcgtagctgtcgagcattttcaggttggcgatgacttccaccgtcgggaagatacgcacttcaaccggcagcatcagggtgataaaaatcatccagaagaagaggttacgtagcggaaaacgaaaccagacaatggcaaatgccgagagcatcgagacggtaattttgccgagcgtaatgctgaacgccatcacaaagctgttaagcaacatccgccagaacggcgcgctattcgtgcctaccccgtttacccagatgttgtggatgttttccagcagatgtgtgccggggattagcgtcatcggtgcggcatagacttcttgtttatccagcgtcgccgcgacaaacgccacgtacagcgggaagaggatcaccgcgatcccgaggatcagcatggtatggctgaatattgtcagccacggacggttctcaatcattggtaacgtaccttgccttcaacatagcggaactgcaccaccgtcagcacgatgacgaggaacatcaacaccaccgactgcgcggcagacgaagccaaatccagtccggtaaagccttcacggtaaatcttataaatcagcgtcgtggtggcctgtactggcccgccggacgtggcggcgtcgatcaccgggaaggtgtcgaagaaggcatacaccaggttcaccaccagcaggaagaaactcaccggagcgataagcggcagcgcaatcttaaagaagcggcgaatcgggccagccccatcaatggctgcggcttcgatcaacgaacgggggatggattgcagcgcggcatagaagaacagaaagttgtagctgatttgcttccacactgaggcaaacaccaccaggaacatcgcctgaccgctgttttgcgcgtggttccagtcgtagccgaactcagcgagaaaatgggtgatcagcccgcgaccggggttaaacagaaagatccacaatacggcggcaacggcgggagccacggcatacggcagcagcatcaaggtttgatagaaacgactgccgcgcacgatgtactccaccagcgctgcgaagaacagcgataccagcaaaccgctgacggtgacaaaggtgctgaattttatcgtcgtccagaaggcgtcgagatagtagctgtcgtgaaacagcgtgacgaaattatccaggccgacaaactggctggagaaaccaaacggatcgacgctttgtagcgagtaccacaacgcttcgcccgcaggccagataaaaaagataacggtgatgatgagctgcggcgcgaccagcaaataaggcagccagcgcgagcggaacaccggacgggatgatgacattacagttaattcctgaactgtgccggatgcgcttcgcttatccggcctacacgcgatgccaggtcagataagcgaaacgcatccgacattacactgattaagacttcgtcgatttctcaaagcggcgcagtaactggttcccacgctcaacggcagtatccagcgcctgctgtggtgtcttcttaccggtccacacgctctccagctcttcatccacaatcacgcggatctgcggcatgttgcccagacgcaaacctttggtgaacggcaacggtggcttgttcagcatctgacgcgtggcaatatccgctcctgggtttttctcgtaaaagccctgctcacgggtcaggtcatacgccgctttagtgattggcagatagccggttttctgatgccactcggcagcgttttctggctttgcgaggaagtcgaggaacttcgccacgccggtgtaggtttctttatctttaccctgcattacccatagactggctccgccgataatggcgttttgcggcgcgtctttcgcatcggcgtcgtaaggcatcatgcctacgccatagttaaatttggcgtactcgcgaatgttggcaagagaaccggaagaggcggtagtcatcgcgcaatcaccgttatagaacttctcggtggattcatccttacgcccaacgtagctgaaatcgcccttcttgttcatctcttcgagcatggcgatgtgtttcacctgctccggcttgttgaactcaagcaccgcgtctgtgccgtcaaagccgttgtttttgctggcaaacggcagaccgttccaggcgctaaagttttccagttggatccagccctgccagccgctggcgtagccgcacttcatgccggaggcttttagttttgcggcatagtccgccagatcctgccaggttttcggcggctgttccgggtctaatcctgctttcttgaaggcgtctttgttgtaatagagaacgggagtcgagctgttgaacggctgggagagtaagtggccggttttgctgtcggagtaatagcctgaaaccgtcggcacaaactgcgactcatcgaattgaatccctgcctctttaaatacgtcatacaccggtttaatggctttcgacgccatcatggtggcggtgccaacttcataaacctgcaaaatagccggagcgttgccggtacgaaatgcggcaatccccgcgcttaaattctgttcgtagttgcctttataggtcggtacaattttgtaatccgggttttcggcgttaaaacgttgggccagagaatccacctctttacccagttccccttccatagaatgccagaacggaatggtcgtcactgcctgcgcatttgccattaaagccagtccgagcgccagtgctgaagctgtataacgtaacggtttcattgattatctctcttgttgtaccgaatgcgcgaattcacgcgttttatgctcgcggagtaacatgacatgctcgaattacagaaaaataactattttgttacatttttaagatagtaaggtgtcagaaagatgacaaggcggtgacggcgcgggcgagggaaaatgggagatggggcacggataagcggaaaaatagaaggtctgaatcaaactctacagattactcatcgtttcatgccggatgcggcgtaaacgccttatccggcctacaagatcgtgcaaattcaatatattgcaactcacccagtaggcctgataagcgcagcgcatcaggcaattttacatttgtcacctgtctcaaaggagtcttttgactccttatcaatcaacgtgttattacccgcctaaatacgcacttctcaccgcttcattcgccagcagcgcgtcgccggtatcggagagcactacatgaccgttttccagcacgtagccgcgatccgccagctttagcgcctggttggcgttctgctcgacaaggaagatggtcatcccctgctcgcgcagttgttcgatggtgtcgaaaatttgctggatgataatcggtgccagcccgagcgatggctcatcaagcaacaacaaacgcgggttgctcatcagcgcgcgaccaatcgccagcatctgctgttcaccgccagacatagtgcccgctcgctgaacacggcgctcatgcagacgtggaaacagttcatagacccactttatgcgctcctggaactggtcgcgttcggcaaaaaagccgcccatcgccaggttctcttccaccgtcatccgcgagaagacacgacgcccttccgggacaatcgctaccgcttcgcgcatgattttcgccgtctgccagtcggtaatgtctttatcatcaaacacaattcgcccgctggtggcgcgcggatcgccgcataacgtgccgagcaaggtggttttccccgccccgttcgcgccaatgagggtgacaatctcgccctgattgatatgcaggctcacctcatgcagcgcctggattttgccgtagtgggcgctgactttgtcaaaggacaacatgactttttccatcttatgcctcacctaaataggcacggatcacatccgggttattacggatctgctccggtgtaccgtttgccagcggcgtcccctgattgaccacgtaaattctgtctgaaatccccatcaccagcttcatatcatgttcaatcaacaagatagtggtgttgtgatggttacgcagttcggcaatcagctcatccagctctttcgtctctttcgggttaagacctgctgccggttcgtcgagcattaaaatctccggctgcgtcaccatacagcgggcaatctccagacgacgctggtcaccataggccaggttactcgcctgacggttggcatgttccaacaaaccaatgcgctcaagccaggtagcggcgcggtcgagcgcttcgctctgggcgcgacggaaagagggggttttcaacaggccggagaacagcccagttttcagttgctgatgctgtgccaccagcaggttttcaatcaccgtcatttcacggaacagacgtacatgctggaaggtgcgcaccacgcccatgcgggcaatttgctgccccggtaaaccttccaggtgctgatcgcgcagtaaaatggtgccgccggtgggtttatagaatccggtcaggcagttgaagaccgtggtttttccggcaccgttagggccgattaacgagacgatttcctgcgggtacagttcaagattgacgttgttcaccgccagcaggccgccgaagcgcatcatcagaccgttaacagataataatgtctgactcatgcctgctctcctttcgctgcgccgttcttcagcttgagttgcgggcgcgtcatgggcagcaagccctgcggacgccagatcatcatcagcaccatcaaaccaccaagcattaacatgctgtattcgttgaaatcacgcatcaactcgcgcgataccaccagcaaaacagccgccagaatcactgcaaattgcgagcccataccgccgagcaccactatcgccagcacaaacgccgattcggcaaaagtgaaggattccgggctgacaaagccctgacgcgcagcaaacagcgttccggcaaaaccagcaaacgcggcgctgatggtaaaggcagtcagcttgatacgacgcgggcttaagcccagcgaacggcaggcgatctcgtcttcacgcaacgcttcccacgcacggcccagcggcatccgcagcaggcggttaatgacaaacaggcttaacaccaccagcagcaacgccaccaggtagaggaagatgacgcgatcggagggatcgtatttcaggccaaagaaattactgaacgtgtcccagccgccttcgcgggcggtacggctgaactcgagtccgaagagcgtcggtttcggaatctgactgataccgttcggtccgccggtaatttcggtgttattgagcagcaatatgcgcacaatttcgccgaacccgagggtaacgatcgccagatagtcaccgcgcagacgcagcaccggaaaaccgagcaggaagcccgccgccgccgccatcaacccggcaatcggcagacaggtccagaagcccagaccgtaatagtgattgagcagcgcaaaagtgtaagcgccgatggcgtaaaagccgccgtatcccagcaccagcagaccagaaagaccaacaaccacgttcagcccgagaccgagaataatgtagatcatggtcagagtggcgatatccaccgtcccacgcgacaccataaacggccacgccactgcaagcaccagcagcgccacgaggaacagtttctgcttcaccgtggagccatcaatcgcgggcagaataaacttcggcccggaaacgctttttagccctttctggaaagcaggccgcacaagctggaagaaaaagaccaccgccgtgccgataaacacccactgccaacggatctctgaagccgtgtcgaccaccagtttggtgccatccagctccagttgcacgcccataaagacgcccgccagcacaaagaacatagcggcagagagcagcgccattgcaatatgcatcggtttcatactttctctacctccgggcgacccagaataccggtcggcatcaccagcagcaccaggatcagcagggcgaatgagaccacatctttatattccgtactcagataggcagaagagagcgcctccgcaatccccaggatcagcccgccaatcatcgcccccggaatgctgccaatcccaccgagcaccgcagcggtaaaggctttcatcccggccataaagccgatgtaagggttaattacgccgtagaactgaccgagcagcacgcccgccactgccgccatcgccgcgccaatcacaaaggtcagcgcaatcacccggtcggtgttgatgccaagcaggctcgccattttcagatcttccgcgcaggcacggcaggcgcgccccatacgggaatagcgaatgaaaatcgtcagtgccagcatggcgaggaaggtgacaatccagataaccgcctgcatggtagtaatagaggcagagaagttttcgctatgacccactacccactgaccgttaaacaggctgggcagcgccacgtcgcgcgaaccttcggtcaggctaacgtagttttgcaggaagatagacataccgattgccgagatgagtgcaatcaggcgcttagagttgcgcaccgggcgataggctacccgttcgatactccagccgtaggcgctggcaatgacgattgcgccgacgaatcccgccaccaccagcagccagccggtatcaatgcccagcatcatcagtgcggcgatgatcataaaggagacgtagctgccaatcatgtaaacctcgccgtgggcgaagttgatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgtttttcacgaacggtgggatgatcacttggctgccgtggatgaaccgtcggcatgccactggaagacaccaaaatcgaatcccttaagatcgcctttttcatcccagttcagcggcccaattacggtgtttgcaccgttagcttttaaatctttcaccagcgccagcggctcatcgctgccggtacgttcaagggcagttgccagagattgcaccgccgcgtaggtgatccagacatagggcccggacggatctttcttgtcggctttcagcgcatcaacgatgccctggtttgtcggatcctggtcatagcgttttggcatggtgaccaacatgccttcagcggcatcaccggcaatgttcgacagcgacgcattaccgacaccttccggccccataaactgggttttcaagccaacggaacgggcctggcgcagcatctgccccatttccgggtagtaaccgccgtagtaaacgaagtcgatgttttcttttttcaggcgggcgatcagcgcggagaaatctttctctccagcggtaatgccgtcgaagaagacgacgttggcgttagccgctttcagcccgtcctgcaccgaacgtgccagcccttcgccatactgttgtttgtcgtgaatgatggcgatgcgctggggcttcaccgtctcaagaatgtattttgccgccgttggcccctgggaagagtccagcccggcagtacgcatgatgtattgataaccgcgttgggtcagctccggattggtcgctcccggcgagatcatcagaataccttcgtcttcatagatatctgatgcaggttgggtagaggaggaacacagatgaccaataacatatttaatgccgtcgttaacgattttgttggcgaccgcaacggcttgtttcgggtcgcaggcgtcgtcatattccacgccaaccagtttatcgcccttaattccccctttggcattaatgtctttaattgcctgacgcgcgccgttaaattccatatcgccccactgggcaatcgggccggacatcgcgccgacaacggcgactttaatatcgtcagccatagcggtgtgtgaaattgtcagtgcaatcatccctgcgatgatagttttcgcattccgtttcatagtcaaaaatccccattcgtgatgttgtgttgctttgtttttatgtgttaacaaatcagactgttctttttttatactgcactgtttttacctgtctgattaagggtttagcgcagtattttgtgatgatagcgattaaaatccctatttttcagtcgattaagaacagataatattctgaatttattgatagataaacagaaaaaagcgccgttgtcagcataaaataacggtacaaagggcagaataattcactaccatttaggggattatgctggatatttttcattctctaatgttttaactttgtaattattgctgaaaaaaaattaatcacctgccaaaagaaataaaaaagagaaagcctccgattaaattatttcgctacactggttccacttttgtgatttacacgggttccccatgaagctgaccatcattcgattagaaaactttagcgaccaggaccggattgacctgcaaaagatctggccggagtattccccttcctctttacaggttgacgataaccaccgtatctacgccgcgcgttttaacgagcgcctgctcgctgccgtgcgggtaaccttaagcggcaccgagggggcactggattctctacgcgtgcgggaagtcacccgacgtcgcggtgtggggcaatatctactggaagaggttttgcgtaacaatcctgacgtttcatgttggtggatggcggatgctggcgtggaagatcgcggcgtgatgacagcgtttatgcgagcactgggatttacggcacaacagggtggctgggagaagcattaatcgtcaagtttgatttcaaaagtgatattgcctgatgcgctacgcttatcaggcctacaatgtgtgctgcaatttactgatttctttgaatcttgtaggccggataaggcgtttacgccgcatccggcatgaagcaacgtactcgatattagcaatttggcggcaacccaaagttgccgattaatgattacttcgcatcagtcgccgtgccgttggcgtgccagtcaaacacaccgaactcaaagcctttcagatcgcctttctcatcccaggtcagcggccccatcaccgtatcaaccgagttcgctttcaggtatttagcgatctccgccggatcgtcagactgattcaggcccgcttgcaaagattgcagcgcggcgtaggtggtccagacgaacgcgccgcttgggtcctgttttttcgctttgatcgcgtcaacaatcggtttgttcgccggaacctgatcgtagttcttcggcttggtcaccagcagcccttctgctgattcacccgcaatgttagacagcgagacgttagccacgccttccggccccataaactgggttttcagccctgccgcacgtgcctgacgcaggatctgccccatttccgggtggtaaccgccgtagtaaacgaagtcgatattctctttcttcagacgcgccaccagcgttgagaaatctttttccccggcggtaataccatcaaagaacaccacattagcattgcctttcttcaggccgtcctgcaccgcacgcgccagaccctcgccgtattgctgtttgtcgtggacgatagcaatacgctgcggtttcactttctcaagaatatatttcgccgccgtcggcccctggtcggagtccaggccggtggtgcgcaggatcagctgatagccacgggcggtcagctccggcgcggttgccgctggggtgatcattaaaatgccttcgtcttcgtagatgtcagacgctggctgcgttgatgaagagcagaggtgaccaatcacgtatttaatgccgtcgttaacgactttgttcgccaccgcaaccgcctgtttcgggtcacaggcatcgtcatattttacgatttgcagtttgttgcctttgataccacctttagcattgatatccgcaaccgcctgctctgcgccagtaaactcctggtcaccgtactgcgccaccggaccggacattgcgcctacgacggcgactttaatatcttctgccagagccatattgctgaatgccagcgcgatacatcctgccagtaacgctttaccctttatgttcatcctgagaatccccactcttctggttattacgtgtgttgtgatgttgttgtgcagcactttatttcgttttatacgtagctacccgtgctttagcagcatactctgctaaaacataccccatttttatgatattggaatagctattttgacagtttattaacaatctgcgtggggattggcgttttgccggagggggaattgattattgtagaggcccaaaaaacaaaaaccccggactctcatccagggttctctgcttaatagcggaaattacgcttcaatggcagcgcgcaattttttcatcgcgttcttttccagctgacgcacacgctcagcggaaacaccgtaacggtcagccagttcctgcaacgtggacttgttgtcttcatccagccagcgcgcgcggatgatatcctgactacgctcgtccagaccttgcatcgcatcggtcaggcggtttgccgcctgctcttcccagttatcatcttcaataccgtcggcaaagttagatgatttatcctgcagatagagcaccggagccatcggctggctgtcggaatcgtcgtcggaagacaggtcaaaggtcatgtcctgtgccgccatacgtgattccatctcacgtacgtctttgctggttacgcccagttcacgggccaccatctcgacttcatcctggttaaaccagcccagacgctgcttggttttacgcaggttgaagaacagtttgcgttgcgctttggtggtcgcaactttgacgatacgccagttacgcagaacgtattcgtggatctctgctttgatccagtgaacggcgaaggagaccaggcgcacacccacttccgggttaaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgcttcagtggtagcaacaactgtgccagagcttaagagcaacgaggttatcattcactgttttatcagaccgtgattttatccacaagttcaatgcaagcttgtgaataaattacgcacaaaatgtgacatagagataaaataccgggaagagacaacggggtctctttccctgctacggaacccattgcagggaaagagtataacacgcttttattattcaggcgtaaagtggcgtaaatgttgtaccgtggcaagccacgctgccacccagccaatcatcgagcataccagcagcaatagcaggcattcatcgaacgataagccattgatatcaaacttcgttccgaaaacctgtgccacttccgcaaccgccgatgacaaacgcagcaccagaatttctgacaaaattagtgacaacaatgcgccagaaaatcccagcaatgcgccaccgtacaggaacggacgcaggatgaaaccatccgtcgcaccaatcagtttctgcacgttaatagaatcacggcgagcaaagatactcaggcgcacactattaccgatgacgaggaacactgccgccaccatcaatacgccgatcattgccgaaacgcgcccgaccagcccggtcaacgccgccaggcgggcaaaccagctgtcatccatccgcacttcgtcaatgccgttaatctgcgtgatacgatcacgcagcgtattcagtgactccgtcccctgaaaatcgagtttcgggatcaccaccgccactgccggaagcgggttttcttccagcatatccagcgcaccaccaaaaccagaccagttacggaactcgcccagtgcgtcttcacgagaaagataattcactttctccacgccttgctcggcctgcaactgtgccaccacgcccgcagcggcgtcatcatccagcgttttttgcagataaacagtgatttgcggtgacggataatattgcgtcgccgcctggttaacgtttttgtacaccatataacagacgctgggcagcgtcagggagatggcgataaccatcaccgttaaaaacgtggcgaacggtttgcttttcagatcctgcaatgcgccgtggaaggcatagcgtacctgttcgttgaaaacgttggttttgcgatttaccggttttggcgaggatttcgcgcgtttcggcgcgttacgaccgccgtcgccagagccgccgaccgatttacggaagcgatccagacgcccgccaaactgccgaatgtgattgattgcatcgcgcttattcatggcccacgcctccatgcaagtgaccatcgctcagggtgagcatgcgataggaacgtcgcgaaatcaggttgatgtcgtgcgttgccatcaatacggttactccaacgcggttaaactcttcaaacagacgtaaaatgccttccgacagcgcgtcgtccaggttaccagtcggttcgtccgccagcagtaccgcgggcttgttcaccaccgcgcgggcaatgccaacacgctgttgttcaccgccggaaagctgaatagggaagttcttcgctttgtccagtagcccgactttatccagcgccgccgacacccggcgacgaatgtcatcaccgctggcaccggcgataatcagcgggatcgccacgttatcatagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaagccaacggcttcgtggaacagtttggcctggcttaccgcattctgcccggtgctggcatcaatagtcagcataacttcatgcggagcttcaacgtcgagtttcttcatcacgcggacgattttcttcaactcttccatcaggtgcgatttgttctgcaggcgtccggcggtatcggcaatcaggacgtcgatgttacgcgctttagcggcctgaatggcgtcgaagataacagaagcggaatccgcaccggtatgctgggcaatcaccggaatattgttgcgctgaccccagacctgaagctgttcaaccgctgccgcacggaaagtatcgcctgccgccagcatcaccgatttaccctgctgctcaaactgacgcgccagcttaccaatcgtcgtggttttacccacaccgttgacgcccaccatcaggatcacgaacggcgttttaccttcaacattcagcggctcatcgactttcgccagaatctcgcccatctcttctttcagcaggccatagagcgcctcggcatcacgaagctgcttgcgggatgcgccttccgtcagattggtgataattttacgagtggtttccacgcccacatcggcgatcaacagctgttcttccagctcttcaaacagatcatcgtcgatttttttaccgcggaacaggctgataaatccggaaccgagattttctttggtttttaacaggctgcgtttcaggcgcgcgaagaaaccttctttggtcggtttttcctgctcctgagcgatttcttccaccggctgctcttcttctgccggagaaaccaccattaccgcctcttctgccgcttcggcagccagcgcctgtgcctccggctcttcgtcggtgatttcgtctttagccgcttcttcttccgccgcttcgacaatctctacggtttccgcttcggcctgccactcttctggcgaaaccgcttcggcgttgacgtcttccggcaacggcagttcttcacgttcgatagccactggctccggcgtttcttctacgaccggttccggctgtgcaacgacttccgcttcaggctgcgctttttcactttcagcaacctgttcagtaacttccacaacgtcggcagcaaaagtttccgcctcggcttcagtatgcgcctgcggctgctcttcaacggcgtgttcagaagccttcacaggctcttgcgcctgaacgatttcttctacaactggttgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccaaatccgcattattggcgggcagtggcgaggccgtaaactcccggttcctgatagtccaggtctgcgccccaccaccgaccgcgtacgcgaaacgttgtttaactggctggctccggtcattgttgacgcccaatgtctggattgcttcgccgggagcggcgcgctggggctggaagcgttatcgcgctacgctgcgggggccacgttgattgagatggatcgtgcggtttctcagcagttaattaagaatctggcgacactaaaagcaggcaatgcacgcgtggtgaacagcaacgcgatgtcattcctggcgcaaaaaggcacaccgcataatatcgtgtttgtcgatccaccgttccgccgtggcttgttagaagagacgataaatttactggaagataacggctggctggctgacgaagccctgatttatgtcgaaagcgaagtcgaaaagggtctgcccactgttccggcaaactggtcattacatcgggaaaaagtggcgggtcaggtggcttatcggctgtatcaacgcgaagcacaaggagaaagtgatgctgattaatattggtcgtttgttaatgctctgtgtttggggatttttaatcctcaacctggtgcatcccttcccacgcccgctgaatattttcgttaacgtggcgctgatttttaccgtgctgatgcatggtatgcagctggcgctattgaaatccactttaccgaaagatggcccgcagatgaccaccgccgaaaaggtgcggattttccttttcggcgtgtttgaactgctggtctggcagaagaaatttaaagttaaaaaataaccttattgttcgcctacaaagctgacaaagcgcgttcctttatagctcagcgtacctttatcacccactgtcagggcgtggtactgctgggcgtcgaggcgaaacgtctgctccattcctccgctttgcggtttgaagcttgcctcatagcgcatactggtgcctgccggcgtcacttcctgctggcgcgaacggcgatcgttaatcggtttttcccgcttgttgctcaccaccaccagcttttgctggagcggtgccatatcattatcagctttttcccgtcgttgttgcataaaacgaaacgatgcggcgacgatgattaagccaatgataacaataaagaaaagaggtggtttactcatctttatccctcatcggaaaatgcggaaataagcataccctgccagttatggtgttgtcatccgtccaccctcgccactaaactggaagcaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgctgttgctggcctggcaagcgccgatgttcgacgccattagctatctggtgctggcggggctgtgtgcctcactgctgggcgatgcgctaaccctgttgccacgtcaacgtctgatgtacgccatcggcgcgtttttcctctcgcacctgctgtacaccatctatttcgccagtcagatgacgctctctttcttctggcctctgccgttggtgctgctggttctgggcgcgctgttactggcgattatctggacgcgtctggaagagtatcgttggcctatctgcacgtttatcggcatgacgctggtgatggtgtggctggcaggtgaactgtggttcttccgtccgaccgctccggcgctctctgcgtttgtcggcgcttcgttgctgtttatcagtaactttgtctggctgggtagtcactatcgccgacgcttccgtgcggataacgccattgccgcggcctgctactttgctggtcacttcctcatcgtccgctcgctgtatctctgataaaacttgactctggagtcgactccagagtgtatccttcggttaatgagaaaaaacttaaccggaggatgccatgtcgactcctgacaatcacggcaagaaagcccctcaatttgctgcgttcaaaccgctaactacggtacagaacaccaacgactgttgctgcgacggcgcatgttccagcacgccaactctctctgaaaacgtctccggcacccgctatagctggaaagtcagcggtatggactgcgccgcctgtgcgcgcaaagtggaaaatgccgtgcgccagcttgcaggcgtgaatcaggtacaggtgttgttcgccaccgaaaaactggtggtggatgccgacaatgacatccgggcacaagttgaatctgcggtgcaaaaagcgggctattccctgcgcgatgaacaggcctccgacgaaccacaagaatcacgcctgaaagagaatctgccgctgattacgcttatcgtgatgatggcaatcagttgggggctggagcagttcaatcatccgtttggtcaactggcgtttatcgcgaccacgctggttgggctgtacccaattgctcgtcaggcattacggctgatcaaatctggcagctacttcgccattgaaaccttaatgagcgtagccgctattggtgcgctgtttattggcgcaacggctgaagctgcgatggtgttgctgctgtttttgattggtgaacgactggaaggctgggccgccagtcgcgcgcgtcaaggggtcagcgcgttaatggcgctgaagccagaaaccgccacgcgtctgcgtaacggtgagcgtgaagaggtggcaataaacagcctgcggcctggcgatgtgattgaagttgcggcaggtgggcgtttgcctgccgacggtaaactgctctcaccgtttgccagttttgatgaaagtgccctgaccggagaatccattcctgtggagcgcgcgacgggcgataaagttcctgcaggcaccaccagcgtagaccgtctggtaacgctggaagtgctgtcagaaccgggtgccagcgccattgaccggattctgaaactgattgaagaagccgaagagcgccgcgcacctattgagcggtttatcgaccgtttcagccgtatttacacgccagcgattatggccgtcgccctgctggtaacgctggtgccgccgctgctgtttgccgccagctggcaggagtggatttataaagggctgacgctgctgctgattggttgcccgtgtgctttagttatctccacgcccgcggcgattacctccgggctggcggcagcagcgcgtcgtggggcgttgattaaaggcggcgcggcgctggagcagctgggtcgtgttacccaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcacaggccattgtgcgcgaagcacaggttgctgaactcgccattcccaccgcccaatcacagcgggcgctggtcgggtctggcattgaagcgcaggttaacggtgagcgcgtgttgatatgcgctgccggaaaacatcctgctgatgcatttgctggtttgattaatgaactggaaagcgccgggcaaacggtagtgctggtagttcgtaatgatgacgtgctgggtgtcattgcgttgcaggataccctgcgcgccgatgctgcaactgctatcagtgaactgaacgcgctgggtgtcaaaggggtgatcctcaccggcgataatccacgcgcagcagcggcaatcgccggggaactggggctggaatttaaagcgggcctcttgccggaagataaagttaaagcggtgaccgagctgaatcaacatgcgccgctggcgatggtcggcgacggtattaacgacgcgccagcgatgaaagccgccgccattgggatcgcaatgggcagtggcacagatgtcgcactggaaaccgccgacgcggcgttgacgcataaccacctgcgcggcctggtgcaaatgattgaactggcgcgcgccactcacgcgaatattcgccagaacatcactattgcgctggggctgaaaggcgttttcctcgtcaccacgctgttagggatgaccggcctgtggctggcggtgctggcagatacgggtgcgacggtgctggtaacggcgaatgcgttacggttattgcgcaggaaataaagaggctatcagtctacggtccaacaatgccggatgcggcgtgaacaccttatccggcctacacagagcatcgaactcgtaggcatgataagacgcgacagcgtcgcatcaggcattgtgcaccgtatcgccagatgcagcttgaacgccttatccggcctacaaaccggtttcaagcagcaacattgagagcgatcggtcccctcgctcctctggggagagggttagggtgagggcaaaaggcggcatcgaagcccatcttcccccatcaaccgcctttacgaatcaaataacgataaggcagtccatccgtctctttagcaaccagttcgtgttccataaaggtacaaaacccaggaatatcacgggtcgtcgccggatcgtcagcaataatcagcaacgtttcacctggctgcatattgcgcactgttttgcgcaccatcattactggttccgggcagcgcaggccaagtgcgtcgagtgtgtggtcagggctggaaaagagatcggtcattttcttctcatcacataaaaaaacggcgctagtttacgccctgtgagtccgtaagcaaaccaggttaacgattgcgtgaaaattaaccattgcattgtcaacgtaaagcagtatcatgcggcggctcgaaaaaagggtcagcacgttattatgttaaggtaacagacgtgtcgtacgtattgggttccctcaccccaatggttaatcaaaaaggtacaatatgaacgttttctcgcaaacgcaacgctataaggcgttgttctggttatcgttatttcatcttctggtgatcacctccagtaactatctggttcagcttccggtctccatttttggttttcataccacctggggcgcgtttagctttccgtttatctttctcgctactgacctgaccgtgcgtatttttggcgcgccgctggctcgtcgcatcatctttgcggtaatgatccccgcattgctgatctcctacgtcatctcatcgctgttttatatggggtcatggcaaggattcggcgcgctcgcccacttcaacctgtttgtcgcccgtatcgccaccgccagtttcatggcctacgcgctggggcagatcctcgacgtgcacgtttttaaccgcctgcgtcagagtcgtcactggtggctggcaccgacagcgtccacactgttcggtaacgtcagcgacacgctggccttcttcttcattgccttctggcgtagcccggatgcctttatggctgaacactggatggaaatcgctctggtcgattactgtttcaaagtgttaatcagtatcgttttcttcctgccaatgtatggcgtactactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaatgctacggcgcagggttcggtcgcagaaagtaacgcgaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagcattatctccgcgaaaggccagacggcgtactcttccgttattctgggtaacgtgggtaatcaactgctaaccatgcaaattacgctgccagctgacaatcagcaaaaagcacagaccaccgcagaaaacatcattaatacgctggttattcagtaagttttaagatgatgaggcggcctcaggtatttccaccggaggccgtttttttaatcgccacgtcagtaataacgcgattgcgaccagtcccgccgccgccagataaatcaccggaacgcccgcccaactcatcaccagcccagccagtggtccggtcacgccaagcgataaatccataaatacggtgtaagttgccagcgccgccccctgattttgctgcggaaccgcttttaccgccactacgcccaatgcagggaacaccagcgaaaaccccgcccccgccagtaagacgccgattttcgccatccacggcatagttgccacgccaaccagtagcaggccgattatctcaacgctaaagcaaatcatcgccacgtttaagccgccgatacggttaatgccgttagggaataacaaacgcgtaccgacaaacgcacagctaaacagcgtcagcgcgaaagccgcaccgtcccaacctttagcgtcataaaacagcgtgataaaggtggcgataacgccaaatccggcggaagccagtgccagcgccataccgtacagccagacgcgcccaagcaccgcacgaaacggcagcggtttgcctttactggcttttaccgtcggacgcgggatcgccaacaaaatggccaccagtgccacgcccataatgattaacgctaacgcctgcaatccgccccagtgataaaacacgacacctaacggcgcccccatcgccatcgccccgtaagtgacaataccgttccacgaaattacccgcccgatatgtagcgaaccaaccacgccaacaccccacagggtcgatcccgttccggcaaaactttgcccaatcccaaggattacgcgcccaaggcacagtaataacaggctgatgacgggcagactggcggttaatcctgccgtcagatatcccagaccgctcaaaaagcagccgcataaaccgaagacgacaatctttttgggtcccagcaaatcggcgtaacgtccggcatgaggacggctcagcaaggtggcaaaatattgcaggctgataaccaaccctgcccagaaggcactaaatcccattacatcatggacatagcccggtaatacagcgagcggcaacccgatggtaaggtagctggcgaagttaaacatgacaatggagacaatgcgcaaattcaggcgcaatccgtttagcgcgggttcggctacgggttcgggcatgaggatcaccacatttttacaacagtgtttcatttttaccacgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagttggcctcactggtagtgatcctcgcaggcattcacgcagcggcagatatcattgtgcagctattactggcgctgttttttgccatcgttctcaacccgctcgtcacctggtttattcgtcggggggtacaacgccccgttgccattacgattgtggttgtggtgatgctgatcgcactcaccgcgctggtcggcgtactggcggcatcgtttaacgaatttatctctatgctgccgaggtttaataaggagctgacgcgcaaactttttaaattgcaggagatgttgccttttcttaatttgcatatgtcgccggagcgaatactgcagcggatggactcggaaaaagtggttaccttcaccacggcgctaatgaccgggctttccggggcaatggcgagcgtgcttttgctagtgatgaccgtagtttttatgctgtttgaagtgcgccacgtcccttacaaaatgcgtttcgcgttgaataatccacagattcacatcgccggactacaccgcgcacttaaaggcgtttcgcattatctggcgttaaagacgctactcagtttatggacaggcataatcgtctggctggggctggagctgatgggggtgcagtttgcgctgatgtgggcagtactggcgtttttgctcaactacgtgcccaatatcggtgcggtaatttccgccgtaccgccaatgattcaggtgctgctgtttaatggtatttacgaatgtattctggtcggcgcattatttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggcagcaaactggcgattttactggggccaggcagaccgaaaagtcggttaccgggatgaggcgacaagtgttacgatacgcactttcattttccattaaacgttggccctgatatgtatcggatagttctggggaaagtttcgaccttaagcgcagctcctctgccaccgggtttacgcgagcaagcaccgcaaggtccacgacgtgaacgctggctggcggggcgtgcattgctttcgcacacgctttccccgctaccggagatcatctatggcgaacaaggcaaacctgcattcgcgccggaaacgccgctatggttcaacttaagccatagcggtgacgatatcgccctgctgttgagcgatgaaggcgaagtcggctgcgatatcgaagtgattcgcccgcgcgccaactggcgctggctggcgaacgccgtattcagccttggggaacatgccgagatggacgccgtgcatcctgatcagcaactggaaatgttctggcgcatctggacgcgcaaagaagccatcgttaaacagcgtggcggcagcgcctggcaaatcgtcagcgtagacagcacctataactcctcgctgtcagtcagccattgtcagctagaaaatttaagcctggcgatctgcacccctaccccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgttctctacactccgccgcactctatttgcgctgttggcttgtgcgtcttttatcgtccatgccgctgcaccagatgaaatcaccaccgcctggccggtgaatgtcgggccactaaacccgcacctttacacgcctaaccaaatgttcgcccaaagcatggtttatgaaccgctggtgaaatatcaggcagacggttcggtgatcccgtggctggcaaaaagctggactcattcagaagatggtaaaacctggaccttcaccctgcgtgatgacgtgaagttctccaacggcgaaccgtttgatgcagaggcggcggcagaaaacttccgtgcagtgctcgataaccgtcaacgtcacgcctggctggagctggcaaaccagattgttgatgtcaaagcactcagcaaaaacgagctgcaaatcaccctgaaaagcgcctactatcctttcctgcaagaactggccctgccccgtcctttccgttttatcgcaccctcgcagtttaaaaaccacgaaaccatgaacggaattaaagcgccgattggcaccgggccgtgggttttacaggaatcgaaactgaatcagtacgatgtcttcgtccgtaacgaaaactactggggcgaaaagccggcgattaaaaagatcacctttaacgtgatcccggacccgactacccgcgcggtggcgtttgaaactggcgatatcgacctgctgtacggaaacgaagggttattaccgctcgataccttcgcccgctttagccagaacccggcttaccacactcaactgtcacagccgatcgaaaccgtgatgctggcgctcaataccgccaaagcccccaccaacgagctggcagtacgtgaagctcttaattacgcggtgaacaaaaaatcgctgattgataacgcgttgtatggtacccagcaggtcgccgacaccctgtttgccccttctgtgccctacgccaacctcggcctgaaaccgcgccagtacgatccgcagaaagcgaaagcgttgctggaaaaagccggttggacgctgcctgcaggcaaagacatccgcgagaaaaatggtcagccgctgcgcattgaactgtcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatacgatccacacgccttcctgagttcaatgcgcgtaccgtcgcacgctgacttccaggcacagcaaggtttagccgacaagccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtttcaaaaccggaactgggtaacatcccctacgcgccgatcgccaccgaaatcccgttcgaacagattaaaccggtgaaaccttaatgttgcgttatgtattacgccgctttctgctgctgatcccgatggtgctcgccgcctcggtgatcatttttttgatgctgcgcctcggcaccggcgacccggcgcttgattatttgcgtttatctaacctgccgccgacgccggagatgctggcctctacccgcactatgctggggctggatcagccgctgtatgtccagtacggcacctggttgtggaaggcgctgcatcttgactttggtatctcattcgccagccaacgcccggtgctggacgatatgctgaatttcctgcccgccacgctggaacttgcaggtgcggcgctggtattaattctgctcacctccgtaccgctcggtatctgggcggcgcgccatcgcgatcgtctgccggatttcgccgtccgtttcatcgcgtttctcggcgtgtcgatgcctaacttctggctggcgtttttactggtgatggcgttttcggtgtatctgcaatggctacccgcaatgggttacggcggctggcagcacatcattttgcctgcggtatccatcgcctttatgtcgctggcgattaacgcgcgtttgctgcgcgccagtatgctggacgtcgccggtcagcgtcacgtcacctgggcacgactgcgtggtctgagcgacaaacagaccgaacgccgccatattctgcgcaatgcctcgctgccgatgatcactgccgtggggatgcacattggcgaactgattggcgggacgatgattatcgaaaacatctttgcctggccgggcgtcgggcgctatgcggtgtcggcgatttttaaccgtgactatccggtgatccaatgctttacgctgatgatggtggtggtttttgtggtctgtaatttgattgtcgatttgctcaacgccgcgctggacccgcgtattcgtcgtcatgaaggagcgcacgcgtgaactttttcctctcctcccgctggtcggttcgcctggcgctgatcattatcgccctgctggcgctgattgcgctcaccagccagtggtggctgccgtatgaccctcaggctattgatttgccgtcgcgcctgctctcgccggatgcgcagcactggctgggcaccgatcatttagggcgcgatattttctcgcggctgatggcagcgacccgcgtgtcgctcggctcggtaatggcctgcctgctgttggtgctgacattagggctgattattggcggcagcgccgggctgattggcgggcgcgttgatcaggccaccatgcgcgtcgctgatatgtttatgaccttcccaacctcgattctgtcgttctttatggtcggcgtgctcggcaccgggttgaccaatgtgattatagccatcgccctgtcgcactgggcgtggtatgcacgcatggtgcgtagcctggtgatttcactgcgccagcgcgagtttgtgctggcatcacggctttctggcacgggccatgtgcgggtgtttattgatcatctggcaggtgcggtgatcccctcgctgctggtgctggcgacgctggatatcggtcatatgatgctacacgtcgcggggatgtccttcctcggtctcggcgtgaccgcaccgaccgccgaatggggcgtgatgattaacgatgcacgtcagtatatctggacccagccgctgcaaatgttctggccggggctggcgctgtttatcagcgtgatggcctttaacctggtgggtgacgcactgcgcgatcatctggaccctcatctggtgacggagcacgcacactaatgccacaacagattgaactccgtaatatcgcgctacaggccgcgcagccgctggtgcacggcgtatcgttaaccctgcaacgcgggcgcgtgctggcgttagtcggcggaagtggcagcgggaagtcgctgacctgcgccgcgacgctgggcattctgcctgctggcgttcgccagacggcgggggaaattttggccgatggaaaaccggtttctccctgcgccctgcgcggcatcaaaattgccaccatcatgcagaacccgcgcagtgcctttaatccgctgcacaccatgcacacccacgcgcgtgaaacctgcctggcgctggggaaacccgccgatgacgctacgcttaccgctgccatagaagcggtggggctggaaaacgccgcgcgcgtgctgaagctctacccgttcgagatgagcggcggcatgttgcagcgcatgatgattgcgatggcggtgctgtgcgaatcaccgtttatcatcgccgatgaaccaaccaccgatctcgacgtggtagcacaggcgcgcatcctcgatctgctggaaagcattatgcaaaaacaagcaccgggaatgctgctggttacccatgatatgggcgtggtagcgcgtctggcagacgatgtggcggtaatgtctcacggtaagattgttgaacagggcgatgtagaaacgctgtttaacgcccccaaacatgcggtaacgcgcagcctggtttccgctcatctcgccctctacggtatggagctggcatcatgactttacttaacgtctccgacctttcccatcactacgcgcacggtggatttagcggcaaacatcaacaccaggcggtgctgaataacgtttccctggccctgaaaagcggtgaaaccgtcgccctgctggggcgcagcggctgcggaaaaagtaccctcgcgcggctgctggtagggttagagtcgccctcacagggaaatattagctggcgcggcgaaccgttggcgaagctcaatcgcgcgcaacgtaaagcgttccgccgtgatattcaaatggtgtttcaggactccatcagcgccgtgaatccgcgcaaaaccgtgcgcgagatcctgcgtgaaccgatgcgccacctgctatcgctgaaaaaagccgaacaactggcgcgcgccagtgaaatgctgaaggcggtcgatctcgacgacagcgtgctcgacaaacgcccaccgcagttaagcggcggccagctccagcgcgtctgcctggctcgcgcgctggcggtcgaaccgaaactgctgattctggatgaagcggtttcgaaccttgatctcgtgttacaggcgggcgtcattcgcctgctgaaaaagctgcaacaacagtttggcaccgcctgcctgttcatcacccacgacttacgcctggtggaacgcttctgtcagcgggtgatggtgatggacaacggacaaatcgtcgaaacccaggtggtgggagataaattaaccttttcctctgacgccggacgtgtgctacaaaacgcggtattacccgcattccccgtgcgccgtcgcaccacagaaaaggtttaacgcaaatgcaacgagtcaccatcacgcttgatgacgatttactggagacactggacagtctgagccagcgtcgtggttataacaaccgttccgaggcgatccgcgatattctgcgtagcgctctggcgcaggaagccactcaacaacacggcacacaaggtttcgcggtgctgtcgtatgtgtatgaacacgaaaaacgcgacttagccagccgtattgtcgccacccagcatcatcaccacgatctctcggttgctactctgcatgtgcacattaatcacgacgactgtctggaaatcgccgtgttgaaaggtgacatgggcgacgtgcagcattttgccgatgacgtcatcgcccagcgcggcgtgcggcacgggcatttgcagtgcctgccgaaggaagattaaccccgtaatcacgccattgtcccaatcgtcttcctgaatcgcagctgtgcgatggtgaaaaacgcgccgccaattgccatcagcgtcaggaactgcggccagacgatttcgaatccggcaccacggtagaggatggcctgcgcgaggctaacaaagtgtgtcgtcggcatggtcagcataatgtcctgcaccatctgcggcatactttcgcgcggcgtggaaccaccggaaagcatttgcagcggcagcaacaccagaatcaccagcagccccagttgcggcattgaacgcgctatcgtccccataaaaatgccgattgacgtggtggcaaacagactgagcgccacgcccagcataaacagcgggatcgagccttcaatcggtacgcccagcacgcctttcaccatcagtaccagcgataatcccgacaccaccagcaccaccagccccatcgaccagaccttcgccatcatgatctcaaacggcgttatcggcatcaccagtaagtgttccaccgtgccgtgttcacgctcgcggatcagtgccgatccggttaatacaatcgccagcatggtaatgttgttgatgatcgccatcaccccaccgaaccacgcgggatcaaggttcgggttaaagcgcatccgggtttccagcgataccaacggttcgctgttatcacggtagcgcgcgacaaagctgttcacttcaccgttgataatattctggatatacccattgccggtaaatgcctggctcatgcgcgtggcatcgacgttcacctgaatatccggctggcgtccggcgaggacatcacgctgaaaattaggcggaatatttatcgcgaaggtatagcgtccggcgtccagcccggcatccatctcatcggcggtgatcatctccggtggcaaaaaccacgggcgatagaagctgttaacgatcctgttcgataactgcgattgatccatatcggcaatggcgatcggcgcgaggttcaacgatcctggcgtaacggtcgctgacgaatacaccgacaccgtaaacgagaagacaatcagcgtcagcatcgctttatcaccgagcaaactgcgcaactctttgatacccagattaaaaatattgcgtaaatggcgcatcatccctcctgttttttcagcagcaggatgcttaagcccatcaccagcgggatggctatcagcaacgggataaaaagttgccacaaatcagtcagatccagcgctttcgagaacgtcccgcgggcgatagtcagaaaatgactggtcgggtaaacctcgccgatccaacgtcctggaccttccagcgaagctaccggatcgatcatcccggaaaactgcgtcgccgggatcaacgtgataatcgccgttccgaaaatggcggcaatctggcttttcataaaggtggagatcagcagccccattccggtggcgatgatgatatacagcagcgccgccagggtgagcgtcaggaaactgcctttatgcggtacgccaaacacaaacaccgacaggccgcagagcaggaaaaagttcagcatccccagcgcgatgtacggtagctgtttgccaagcaaaaattcgctacgggtggtaggagtcacgtaaaggttgataatcgaccccaactctttttcccgcaccacgctaagggcgcttagcattgacgggatcatcatcagcagaagcgggatcaccgccggaacaatcgctggcaggctttttacgtccgggttatagcgatagcgcgtctcaatgttcatcagcacgctttggctggagggtgtggattgtcggctcgccacatcctgtagccagctctggtgcatggcctgcacgtaaccttttaccgtttcggcacgactgggcatcgcaccgtcgatccagacaccgagttccacaggcgtaccacgcgcgatatcgcgcccgaaattgggaggaatctcaatcgccaccgtgatatcgcccgcacgcatccgacgatcaagctcgtcataactggtgagcggcggctgttcgataaagtaacgggaaccggagagattgagcgtccacgcctggctactgacggtctggtcgcggtcgagcaccgcaaagcgcaggttttccacatccatactgatgccgtaacccattatcagcatcaggatcaccgttcccatcagcgccagcgtcgaacggaccggatcgcggcgcaattccagtgcttcgcggcggctgtagctaaacagacgacgcaggctaaatccctgacgcggcgcgtgggtggtgtcgtgtatcacgggcggcgcttcggcttcgttgctctgccctgccgcttcctgcaaataggcgataaatgcctcttccagactggcggatccgcgtttctcaaccagttcctgcggtgtaccgttggcgagcacttttccggcgtgcatcagtgagatacggtcgcaacgttccgcttcgttcataaagtgggtggagatgaagatagtcactttgtcctggcgcgagagatcgaccatcaactgccagaacatatccctcgccaccggatcgacgccagaagtaggctcatcgaggattaacatctccgggcgatgaatcaccgccaccgccagcgaaagccgctggcgaatgccgagcggcaatgactccggcagaacatcttcaacgtcgttgagcttaaaacgctcgctcatttcagccactcgcgcgggaatttccgcttccgggatgtgaaacaaacgggcatgtaactccaggttttgccgcacggtgagctcgttatagagcgaaaacgcctgcgacatatagcctacccgacggcgagtatcgatatcttttggatcaaccggttgcccgaacaaccacgcctcaccttcgctggcgggcagcaatccggtaagcattttcatggtggtggatttaccgcagccgttcgaaccgaggaaaccaaaaatctccccgcgtggaatgcggaaattgacgtgatcaacggcaacgaaggaaccaaaacgcatggtcagatcgcgcgcttcgatggcaatctctgcgttttcaggttgatacggtgggatcactaccgcctgatgcgcctggcgttgtgcttgcggtaacagatttataaatgcttcttccagcgtggcgctttgcgtttgctgccgcagctcttcggcgctgccggttgccagcacctctccggcattcatcgctaccagccagtcgaagcgttcggcctcttccatgtaggcggtggcgaccagcacgctcatattgctctgccgctggcgaatactgtcgattagatcccagaactgggcacgggagagcgggtcaacccccgttgttggttcatcaagaatcaacagttccgggtcgtggattaacgcacagcacagcccaagtttttgcttcatcccgccggagagtttccctgccggacgatcgcgaaacggtgctaacccggtgctggtcagcagctcattaattcgcacttcccgctccgctttgtcgtgaccgaacaggcgggcgaaaaaatcgacgttttcatacaccgacaaggtgtggtagagatttttgcccagcccctgcggcatccaggcgatgcgcgggcagacgtcgcggcgatgcttcgggtcgcgcatatcgccgcccagcaccatcacgctgccctgctcaatgacgcgggcaccggaaatcaacgacaacaagctcgatttaccgacaccatccggtccaatcagcccgaccatgcaacgggccggaatatcgagtgtgatattgttcagcgcaacggtttttccataatgctggctcacgcccgccagttgcgcgacaggcgggacgggaaccagttccagatgcgtcattgcggcaacctcaccaccaggtcgtcaggccacggaagttcttcattcacccgcacccacgctacgcccggcaatccggttttgacatattccagatgctgctggagtaattccggtgggatacgcgctttgacacggaacatcaatttcagccgctcatcgctggtttcgacagtttttggcgtgaactgggcgacgctggcgacaaaactgatggtcgcgggaatacgcagatctggtgcagcatcaagaatcaaacgtgcttcaccgcccagtttcagcgtgcccgcctgttcggttggcagaaagaaggtcatatagacgtcgctgagatcgaccatattcagcacccgaccgcctgctgccagcacttcgcctggctcggcaacccgatactgcacgcgtccgtcacgcggggctttcagttcgctgtcatcgatatctgcggcaatgcgccgttcagtggcttgtgccgcttcgacgcgagtttgcgcctgaatgatattggtgcgtgccgcctctatagcggctttagaagcagaaacctgagcttttgccgattccagcgcagctcgggcgctctcagcggcggcgcggtcgtcatccagctgttgcgcagaaattgccccccgttgtgccagtgagcgggaacgcgtatgacgttttgctacggagtccagttctgcctggcgttgattaaccagcgactgtgcggcacgagtttcgctttggcgttgctccagcaaagcctgcgcggcggcaacggcactttgtgcttctttgatttgcgcgatggcttccagtcgctgttcctgcaacacgcgagtatccatcttcgccagcacttcaccttctcgaacaaactggccttctttcaccagaatggtgtcgatacgcccggcaattttgctggcgatatccacttccgtcgcttcaatgcgcccattgctgacagcaaagccttccggcacacccgccgggcgcaacagcaaccacgccacgacggcagccaccgccagtgccccgacaccccaccacgccagatggcgcttactcttatccataatcgatccgccataatccctgtaagcaatcgacgcgtgttacaactgccaccgaacgatgttcagcggattcttccatccgggataagaaggaaatggcaaatacgaccagcgcacagagcattgagcgccaatggggaaagcttagtgaaaacgggtagtaatgttgtcatcatcagcattcctggccgtaaatgaaacacgcatactcataagtgaaatcaattaaatactaacagttatattcatgttgtctatttgattgccatcaacttgtgatacatcgcgatgttcttccgttcgctggtgttttttccaaaaatattctgtacaggttcacagattctgttgcacaggtttccgtaacagggaaacctgatgactatcacatagcgttattatcgcctgatgtgcgaataaataccgaatataaaataatttattctgaaaagatgatagatgataaaggttcgtgggtttaataaaatattccctaaaagactcatttaaaacaacaaaataagataaagatattaattcagagtttatcttaggataaatatttatttaatagcattaactcaccgctaaaagttgatccccataacgctaaatccgattatagtgaagttactttttttaattgatggcatcttatagacatatttaactaactgaaaagacgaatcatatgtttttcgaagtgtagcagaaaatatatatggggtttaaaatgaatatatatatcggatggttgtttaaattaattcctttactgatgggtataatatgcatcgcattaggtgagtttgtattaaccggttcagggcaaagtgaatatttcgttgcagggcatgttctgatttctctttctgcgatatgtctggcattgttcactaccgcatttattattatatctcagttaactcacggcatgaataaattctacaacaggttatttcccgttattggttatgccggttctgctacaactatgatttggggatggtcactgttggcaagcaataatgtgatggcagatgaatttgtcgccggtcatgttattttcggcgttggcatgattgccgcttgtgtatcaaccgtagcggcatcttccggacattttctgttgatccccaaaaacgcctcgggcagtaagagtgacggtacgccattgcaggcctattcttcaacaatcggtaatagcttaattgccgttcccgttctgcttactctctttggtttcatttggtcagtcatactgttacgtagtgcagatatcacaccacattatgttgcaggtcacgtactaatggggttaacggcaatttgcgcttgtcttattggccttgtcgccactattgtccatcaaacgcggaatacgttctcagtgaaagaacattggctgtggtgctattgggttattttgcttggctcacttaccattatttttggtatctacgtattaatcagttcagatgcaagcgcccgcctggcccccggcattattctcatttgcctggggatgatctgctacagtattttctccaaagtgtggttgttagcgctggtatggcgacgcacatgttcgttagccaacagaatacccatgattccggtatttacctgtctgttttgtctgttccttgctgcgttcctggctgaaattgcgcaaaccgatatggcttactttattccttcgcgagttctggtgggcttaggtgcagtttgttttacactgttttccatcgtttctatattagaagcgggttcagcgaaaaaataataaaaaaggcttcagataaggcgttgggcgccttatctggttttattcaggttaatccctctggtatcgagagcgcattttgcttcttattctgccaccaaatcctgcgcacaagcccatgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcacttcggcagtgcgatagccttcagtgccgttgggttgtacgcgccagtcagtcaatgtgctaatcagtgtctgttggtcacgcacgttgagctgttttagcgagacatccgggatttgcccgagttgttgtaaccgttcaaccaaccgcttcggcagatgaaccgccagcgtgtttttcaggctttgattcggatgtgcattacgctgctcattcaggaaggtttcgaggtccacatccggtagcagattgatgctgacaaattcacccggttgccagtagctggaaatctgcaacaccgccggtccagataagccgcggtgggtgaagagtaagttctcacggaaaacggtaccgttttcagcggtaatcacggaaggcaccgccacgcccgccagcacctgtaactcttcaagcaacggtttatgcagagtgaatggcaccagacccgcacgggtcggcagcacgttgaggccgaattgttcggcaatcttataaccaaacggcgatgcgcccagccccggcattgacagtccaccggtcgcaatgaccagcttttcgcaaccgacagtcatgccgttcagttcaagcgtgaagcctgtatcatccttcgccacgctcagcacttcgctacgcaatctgaaggccacattgcccttctcgcactcatccaccagcatgtcgacaatctgctgcgcggagtcatcgcagaagagctgccctaacgttttctcgtgccaggcgatgccgtgtttattgaccagatcaatgaaatcccactgggtaaaacgcgcgagtgcagacttacaaaaatgcggattctggctcagataagcgcccggttcgacataaaggttggtaaagttgcagcgcccaccgccagacatgaggattttgcgccctggttttttaccattatcgatcagcagaacccggcgtcctgcctgacctgccagcgcagaacagaacatacctgccgcaccagcgcctataataatggcatcaaacctttccacgttgcgctcctctaagaaaaaacgggcgtgaattgtaaagattcctcagtggtcgcaccagcatcaatattactaaaaggaagtatttgcctgaattatataagataattattttttgagtggaatccatacaggaggcaaatcaaaaaaagtctatatttcactttgcccgcgccgcgaaagtcactgataatgcgccgcgttcatgtcctcaaaatggcgtaacgtcctatgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtgttcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctgggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttctctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcacggcgcgaacgatggtcagaaaggcattggtctggttatgttggtattgattggtgtcgcaccagcaggcttcgtggtgaacatgaatgccactggctacgaaatcacccgtacccgtgatgccatcaacaacgtcgaagcttactttgagcagcatcctgcgctgctgaaacaagcgaccggtgctgatcagttagtaccggctccggaagctggcgcaacgcaacccgcggagttccattgccatccgtcgaataccattaacgcgctcaaccgcctgaaaggcatgttgactaccgatgtggaaagctacgacaagctgtcgcttgatcaacgtagccagatgcgccgcattatgctgtgcgtttctgacactatcgataaagtggtgaagatgcctggcgtgagtgctgacgatcagcgcctgttgaagaaactgaagtccgacatgcttagcaccatcgagtatgcgccggtgtggatcatcatggcggtcgcgctggcgttaggtatcggtacgatgattggctggcgtcgtgtggcaacgactatcggtgagaaaatcggtaagaaaggcatgacctacgctcaggggatgtctgcccagatgacggcggctgtgtctatcggcctggcaagttataccgggatgccggtttccactactcacgtactctcctcttctgtcgcggggacgatggtggtagatggcggcggcttacagcgtaaaaccgtaaccagtattctgatggcctgggtgtttacccttccggctgcggtactgctttccggcgggctgtactggctctccttgcagttcctgtaattgtacgcaccaaaacgagcgggtcagtttactggcccgctttttttatgcgtcattattgctgaattgcttaatgccaaatcatcaatgcaatcaggctgaccaccaccagaccacacaatgcgctggtcagaataaactgccgacgcacccgctcacagcggcgaataaactcatcatcgtgatgatcgcgataacgttgggcatagatataccaaacgagacgcacctgtttgttgggttggccatgtgaggtaaaaaagccccctccatcaacatattgatagagcaatggatcgcagttacgcagtaccactaacaacgcgcgtagtgatgagaaatagcgcgccatgttaacaatgcaaacgacacataaagcccaaaataatgcgacggtgcttatcatacctcctccccggcgacctgcccgcggagttccaccccggggctaccgctcccgatacgctgccaatcagttaacaccaggtcctggagaaaccgcttttgtggtgaccaacatccgagcggctctatagatagtgtaggagatcaggttgttttttttccagaaggttaaccactatcaatatattcatgtcgaaaatttgtttatctaacgagtaagcaaggcggattgacggatcatccgggtcgctataaggtaaggatggtcttaacactgaatctttacggctgggttagccccgcgcacgtagttcgcaggacgcgggtgacgtaacggcacaagaaacgctagctggccagtcatcgacaactttatggaaggagtaacactatggcttataaacacattctcatcgcggtcgacctctccccggaaagcaaagttctggtagagaaagcagtctctatggctcgcccctacaatgcgaaagtttctctgatccacgtagatgtaaactactctgacctatacaccgggcttatcgatgtgaatctgggtgatatgcagaaacgcatctctgaagagacacatcatgcactgaccgagctttcaaccaatgcaggctacccaatcactgaaaccctgagcggcagcggcgatctgggccaggtactggtcgatgcaatcaagaaatacgatatggatctggtggtttgtggtcaccaccaggacttctggagcaaactgatgtcttccgcacgtcagctgatcaacaccgttcacgttgatatgctgattgttccgctgcgcgacgaagaagaataatcttccctccacgacgtgttcctgaacgcccgcatatgcgggcgttttgctttttggcgcgccttgttacctgatgcagcgtaaacgccttatctggcctgcggtctacgtacgcaatcaaaacccctgccaatacaacatttaacaccatcatattttctatcattagtgtgatcagctggttattttctgttgtaatagtgtattaatctattctccgcatcaatattaagaatctctgacagatgtaaactttttcgcgcgttatcccttacgcgttaatacttttcaggatggtattggaaggttaataaatatgaatacaacaacacccatggggatgctgcagcaacctcgcccatttttcatgatcttttttgtcgagttatgggagcgattcggctactacggcgtgcagggcgtactggcggttttcttcgttaaacagcttgggttctcgcaagagcaggcttttgtcacttttggtgcttttgctgcgctggtctatggcctcatttccattggtggctatgttggcgaccacctgctgggaaccaaacgcaccattgttctcggagcacttgtgctggcgattggctacttcatgaccggcatgtcgctacttaagcctgacctgattttcatcgctctggggactatcgctgtcggtaacggcctgtttaaagctaacccagccagcttgctttcgaagtgctacccgccgaaagatccgcggcttgatggcgcattcaccctgttctatatgtcgatcaatatcggctcgttgatagcgttatcgctggcccctgtgatcgctgataaattcggctattcagtcacctacaacctgtgcggtgcagggttaattatcgcattactggtttacatcgcctgtcgtggaatggtgaaagacattggttctgaacccgacttccggccgatgagcttcagtaaactgttgtacgtattacttggcagcgtggtgatgatcttcgtctgcgcctggctgatgcacaacgtagaagtcgccaatctggttctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacgtcgctgaacttctttgccatcaacaacgtgcatcatgaaattctcggcttttccatcaacccggtcagcttccaggcgcttaacccgttctgggtggtactcgccagcccaatactggcaggcatttacacgcatctgggtaacaaaggcaaagatctctcgatgccgatgaagtttactctcggcatgtttatgtgctcactgggctttttgacggctgcagcggctggaatgtggtttgcggatgcccaggggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcagtaccagacaacattaccgatccacttgagacgttgcccgtctataccaacgtgtttggtaagattggcctggttacgctgggcgttgccgtagtgatgctattgatggtgccgtggctgaaacgcatgattgcgacgccggaaagccattaattattcttgcagaaagcagggtagcattatcgctaccctgctttacttttacaccggcgttccggcataaatatcaaagcgatgccctttagtgactaccgcgtttggcgtggcgacattcgccagcggcggcgcatagtccggacgcttcaccaccacgcgtttggttgccagcaaccgcgcaggctccaacaatccatcggcatcaagatccggccccaccagcgactgaaacacgcgcatctcttttttcaccagcgcgcttttctgcttatgcgggaacattgggtcaagatagaccacctgcggacgcggggtgatatcgctcagcgccgtcagactggaggcgtgaatcaactgcaaacgttcctgtaaccagccgccgatttccgcatccgcataaccacgcgccagaccatcgtcgagcaacgcggcaaccaccggattgcgctccagcatccgcacgcggcagccgaccgaagccagcacaaaggcatcgcgccctaatcctgcggtggcgtccaccacatccggcaaataatcgcctttaatgcccaccgctttcgccaccgcctctccgcgaccaccgccgaatttgcgtcggtgcgccatcgctccgccaacaaaatcaacaaagatgccgccaagtttcggctcatcacgcttgcgcagttccagatgctccggcgttaacaccagcgccatcaggttgtcttcatcgtgttccagcccccagcgggccgccagaacagataaggcgccgtctccggcgcctgtttcatcaattaagcagattttcactgaatgttcagcccataatgccgtaatgctccagcatcgcatccagctgtggttcacgaccacggaagcgtttgaacagctccatcggctcttctgaaccgccacggctcagaatgttgtcgaggaacgactgcccagtttcacggttgaaaatgccctcttcctcaaaacgcgagaaggcatctgctgccagtacatcggcccacaggtagctgtagtaacctgccgcataaccaccggcaaaaatgtggctgaaagcatgcgggaaacggccccatgacggagacggtaccacggcaaccagtttcttgatttctgccagagtttcgaggattttcgccccctgatccggacggaactcggcatggaggcggaaatcgaacaggccgaactccagctggcgcagaataaacagcgccgcctggtaatttttcgctgccagcattttatccagcagctccttcggcagcggctcgccggtttcatagtgaccggagataaacgccagcgcctccggctcccagcaccagttttccataaactggctcggcagttcgaccgcatcccacggcaccccactgatcccggaaacaccagcggtttcaatgcgggtcagcatatggtgcaggccgtgaccgaactcgtggaacagggtgatcacttcgtcatgggtaaacagcgccggtttaccatttaccgggcggttgaagttgcaggtcagatacgcgaccggtttttgcagcgaaccgtcggctttacgcatctggcctacgcagtcatccatccacgccccgccgcgtttgttttcacgggcatacaggtcgaggtagaagctgccgcgcagttcgtcgttctcgtcatacagctcgaagaaacgtacatccggatgccagacatcaacatctttacgctctttagcggtgatgccgtaaatacgtttcaccacttcaaacaggccgttaaccgctttgttttccgggaagtacggacgcagttgttcatcgctgatgctgtagaggtgctgtttctgtttttcgctgtagtaagcgatatcccacggttgtaactcatcgacgccaaattcggctttggcgaaggcgcgcagttgcgccagctctttttcgccttgcgggcgcgcgcgttttgccagatcggttaagaaatccagcacctgctgcgggttttctgccattttagtggcaagtgatttgaaggcgtagttttcaaagcccagcagttgcgccagttcgtgacgcagcgcgaggatctcttccatcaccttgctgttgtcccacttaccggcgttcggaccttgatcggaagcacgagtgctataagcgcgatacatctcttcacgcagggcctggttgtcgcagtaggtcattaccggcaggtagcttgggatatccagcgtcagcaaataaccttccagctctttcgcttcggcctgggcttttgccgcagccagcgcgctttctggcatccccgccagctccgcttcgtcggtaacgagtttggtccagcccatcgtcgcatcgaggacgttgttgctgtactgattgcccagttcagaaagacgggtagcaatttcgccgtaacgctgctgtttctctttcggcagaccgatgccagagagttcgaagtcgcgcagtgcgttatcaaccgcttttttctgcgccgtgttcagcgtggcgtaatgatcgccatcgcgcaggtcgcgatatgccttatacagcccttcatgttgccctacccaggtgctgtattctgacagcagcggcagggtttgttcgtacgcttcacgcagttccgggctatttttcaccgagttcagatggctgaccggggagaagatacgccccagcacatcgtccacttccgccagcggctggcagagattttcccaggtgtacggtgccccttgcgctactacgcgctccacattttcgcggcagtcgttcagcgccttagtcacggctggaacgacatgttccgggagaattttagaaaacggaggcaattcaaagggagtcagtaacggattcgtcattagcgcagtcctggttaaagaggttaaggaagcgctcaacaggcgctttacataatgtttgtagcatggggttaagtgtagtgaatttcaatgagaaacgttacgctttcgcggcggcggcctcttttcggtatactgtcctgataggcttttgtgcgccccgaatacgggccgatttttacttaccggaacacctttacccatgctcagttatcgccacagctttcacgctggcaaccacgccgacgtccttaaacataccgttcagagcctgatcattgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcctgcggagctggaggcgtacatcaatgtggtaaaacacttcaaccgtagcgggcagttgcgttattaccccggttcgccgttgattgctcgccagctactgcgtgaacaggacagcctgcaactgaccgaactgcacccgagcgattacccgttgctgcgttctgaatttcagaaagacagccgtgcgcgcgtcgaaaaagccgacggtttccagcagcttaaggccaagctgccgccggtttcccgccgtggtttaatccttatcgacccgccgtatgaaatgaaaaccgactatcaggcggtggtcagcgggatagcagaaggttacaaacgtttcgccactggcacttacgcattgtggtatccagtggtgctgcgccagcaaattaagcgcatgatccacgacctggaagcgaccggcattcgcaaaattctgcaaattgaactggcggtgctgccagacagcgatcgccgtggcatgaccgcttccggcatgattgtgattaacccgccgtggaagctggaacagcagatgaataacgtgctgccgtggctgcacagcaaactggttccggcaggcaccgggcacgccaccgtaagctggatcgtgccagagtaattgcagccattgctggcacctattacgtctcgcgctacaatcgcggtaatcaacgataaggacaatatgtcatgactaaacactatgattacatcgccatcggcggcggcagcggcggtatcgcctccatcaaccgcgcggctatgtacggccagaaatgcgcactgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgagaacgtgctcggtaaaaataacgttgatgtaatcaaaggctttgcccgcttcgttgatgccaaaaccattgaagtcaacggcgaaaccatcacggccgatcatattctgatcgccaccggtggtcgtccgagccacccggatattccgggcgtggaatacggtattgattctgatggcttcttcgcccttccggctttgccagagcgcgtagcggttgttggcgcgggttacatcgccgttgaactggcgggcgtgattaacggcctcggtgcgaagacgcatctgtttgtgcgtaaacatgcgccgctgcgcagcttcgacccgatgctctctgaaacgctggttgaagtgatgaacgccgaaggcccgcagttgcacaccaacgccatcccgaaagcggtagtgaaaaatgccgatggtagcctgacgctggagctggaagatggtcgcagtgaaacggtggattgcctgatttgggcgattggtcgcgagcctgccaatgacaacatcaacctggaagccgctggcgttaaaaccaacgaaaaaggctatatcgtcgtcgataaatatcaaaacaccaacgttgaaggtatttacgcggtgggcgataacacgggtgcagtggaactgacaccggtggctgttgcagcaggtcgccgtctctctgaacgcctgtttaataacaagccggatgagcatctggattacagcaacattccgaccgtggtcttcagccatccgccgattggtactgttggtttaacggagccgcaggcgcgcgagcagtacggcgacgatcaggtgaaagtgtataaatcctctttcaccgcgatgtataccgccgtcaccactcaccgccagccgtgccgcatgaaactggtatgcgttggaccggaagagaagattgtcggtattcacggcattggttttggtatggacgaaatgttgcagggcttcgcggtggcgctgaagatgggtgcaaccaaaaaagacttcgacaacacggttgccattcacccgacagcggcagaagagttcgtgacaatgcgttaaatgttaaagggctaagagtagtgtgctcttagcccttagctacgtttccgctatcagttcagaagctgaagcagaaagcggatcagttccagcagcgcaattaacgccccaagaacgatgattgctttatcaatcacccgttttctccatgcgatggagtgagaatgcatccgcttactcatccattgcctgtcacggcgcatgtctcattgttagatgacgactatctcactccggccagagcatcagttaacggcaccacccgtacttcagaccaggactttgaaagcgtttatgcgcattgccagagtgaaaatgtctcagagctaactggataatcatacagtacttgcgggttataaaaccagcatgtccttgcaatagtttcagtatggtattagcattgatgcgttagatgatggctatctcactccagccagagccaccaactcagggctgaacagtaaaaaaaccgacgcgaagtcggtttttttacgtcctgattcagacctcctttcaaatgaatgcccaacgcttaattcacacctacacctttctctacacttacatattcgttaaaccatatgtgtttttgacttgtccgctttggtttgtaactctggtggcgctggcgctacacctctctttcacatcgtaatgagatactgatatgagcaacattaccatttatcacaacccggcctgcggtacgtcgcgtaatacgctggagatgatccgcaacagcggtacagaaccgaccattatctattatctggaaacaccaccgacgcgcgatgagctggtaaaactcattgccgatatggggattaccgtacgcgcgttgctgcgtaaaaacgtcgagccgtatgaggaactgggccttgcagaagataaatttactcacgatcagttaatcgactttatgcttcagcacccgattctgattaatcgcccgattgtggtgacgccgctgggaactcgcctgtgccgcccttcagaagtcgtgccggaaattctgccagatgcgcaaaaaggcgcgttcaccaaggaagatggcgagaaagtggttgatgaggcgggtaatcgcctgaaataaagcggctatattcccccacaggttgttagaaaaatgcgctttatttatgtcggatgcgacgctggcgcgttttatccgacctacaaagttatgataattcgatgaattgtatgttatttgtaggcctgacagtcgtagcgcatcaggcaattttgctatttacacagtactccctgcgtgagattccaattatcgcgtccagcatggtgtatctgtgagctgcttagttatcagcgatacagtgcagcactgtaaagatgtactggattatgatttatcagtggtttacacaataaataatttcaacatacgttaacctattttattattacatatctaaaacatcacaaaaatatcacttcacacactatcagagaacatcatacctttttaaaacgagcattttcgatagttgttaacgttttcttttgcgatatgattattgcctttttttgcactcaaatattaccagatggaaataaaagagaagtcaaaggtaattatatcaggaagatatgacgcattatatttactgtatgtagaagaaaatccattcctgttctaattatccaatttaaaaatcttagcataaaacaaatgatgaataaggaatgttatgtcaattgactttaccccaggtgtaataaatacatataacggtgatatttataactgcacaacaaataccgataatgttaaaacgccagacacaccgaagtggccttgtgataaccgggaagaacaacaccccattaatgccccattctctggagaatggatacacctctgaacaatttgatttagcgcaacaacgccaacaaattaatgcgtgccatacgaacaccacatatacaaatgcagactactcaaagttgaggctcaacttgtaagtcttattaataacattgaaacgataagctcgacaccacttccgcaaaagacacaatcaatacttaatcagataaataatattagacacgaaaagattaaaaacctctgaatatagattatggaacaatggatactcatgccacgcccaaaaattaactgagctcaactaaacagaagagatataaacatcagacaggtttacgttactatcaggcatatcgcctcagaatcagatgaaaactataaagaaatatctattatggttttaatatttgttgataaggatagtaacatgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggcgggaaggttatcaacgttatcaatggcaaaacggatacgttgttagaaatcgctgtattaccgttggatagctatgcgaagcctgatattgaagccaactatcagggccgactgctcgccagacaaagcggcttccttgatccagtgaactatcgtaatcactttgttaccatcctcggtaccattcagggtgaacaacctggctttatcaataaagtcccgtataacttcctggaagtgaatatgcagggcatccaggtgtggcatttgagagaagtggttaataccacctataacctgtgggattacggctatggtgcattctggccggaaccgggctggggggctccttactacaccaatgcggtgagtcaggtaacacctgagctggtcaaataacaccaccgaaagatgcagatgctttctcagcatctgcatcatgcattacatcaaattaatacacagtaagctaactattattataagccctgtcctgttaattacctttggcaaacttattataaagttaatgtccgtgccaggagtcggttatgtttcttataattaccagggatacgatgtttttcaccgcgatgaaaaacattctgagtaaaggtaatgtcgttcatatacagaacgaagaagagatcgacgtaatgttgcatcagaatgccttcgtcattattgatacattaatgaataatgtatttcattctaattttctcactcaaattgaacgattaaaacctgtccatgtaattattttctccccctttaatattaaacgctgcctggggaaagtaccggtgacctttgttccgcgaactatcgccatcatcgactttgtcgcactcatcaatggcagttactgctctgtgcctgaagcggatgtgtccctctcgcgcaagcagcatcaggttctgagctgcattgcgaatcaaatgacaacggaagatattctggagaaactgaaaatatcgctaaaaacgttctactgccataaacacaatatcatgatgatcctcaatcttaagcggatcaatgagctggtacgccatcagcatattaattatctggtgtgaacgattgaacaatataaagaggcccagcaacagccagacctcccgttaattatacgttatgcagtaacgccttccggtatcaacgaagcaatttgcttacgccattgcgcttgctcctgttcaccttctgtacgttgaccataaagttgcgctatctgcgtaccatcatgggcaaacaattccaggctggttacgtggccatcgctggtcggtttacgggtaacccaggcttcagcaatgctctcttctaatagatgaagggtaaacgtcgggttgaaaatattcagccaacctttcattggcaccactttttctaccacaccggtgaaaatctgtacgcagccacggttgccaacaaacaccatgatttcattgccatcctgctgtgcagattcaagaatttgcgccaacgcactgttggatactttgcaggccaaatcgtctgccaccagattgaacgcctgttggcgcgtcaggttgtggcgcttgagcaacgtaaaaaactgatgaacgtcggtcatcgcccgccactcttgctcgaccacactggcatcggctcgcgtttgaacaactggcgcatcaacggcttttaactcaagcggcgtattctcatcggtgataaaccgtgccagaagctcactccatgccgccatatcggtattgtcggtggcataaacttttagtaatgcatcgccctgatgatcaaagaactgaatactctggcgttcgccacgagccgtgttttctttgatgtggaaaacactggcccattgattgagaaacagacgtaaatccagcgcgcgcggattgaggatcaatccggcatgtccgttcaaatgctggtttgtgaacgagccaacttgctcatggactgcatattcattacgacaaatacatttggtttcaccaacgctttccagcgccgccagaatttcacgaatatcgccgcgcatccgccacgcgtcgtgcgtgacgcgtgcaaatgccagttctgcttcgctgatattcattaaacctgcgatgtcacgcgcgtactttccgggattttgttcttttaactcaagccagcgtgtgtagtggttcattgtctctcttccttccagataaatgccccgaaatatcggggcagatgattaccattgataactcacgaaaatttttccgttacgaccatcctgtgggatgccttgcggcgaccagtactctttatcgaaggcgttgcccaataccagagtagtggtcatgcctttgagcgcctgctgcccttgataactgacgtagaaatcattcacaccatagccaggttgtttgctgtagctgctgctgatatgtgttgagcgatcggcaaacgtaccgacccaaccaacagagaagccactgtgagcgatcggaatattcagggtactggtaacggtatccgggttaatgctggagatatattccccggtatcggtgtctttgccgcgggtacggttataggccacatcaaggctaaacagatcagtggtatatttcgtcatcacatcccagccccagattttggcgttcgggacgttatacgacatagttgtcgccgccgcgaaatcgacggtcgtggagatataatctttcgctttggtatcaaagtagctggctttaaattccagagcatcattggacaacatcaggtcatcaaaacgcagcccaaaaccgtactcctgagtttcgttagtttccggacgtaagttcgggtttggcacccaatagttggtatagaagcgaccaatcgagaagtgtttagaatcgttatacatttcgcccatcgtcggggcgcggaatgcctgagcatatgagccaaataacatcagccagttggtcgggttgatagtcatccccgcacgagatgaccatttgtcggcatcaacatctttgtagccgtcgctgctaccgcgataactgtcatagcgggttccgccaagcagggtaatcggcagatcgcgtaaggtgatctcatcttgtagccagccagagctaaaatcgatttttgcttgcgggaagcccgtcgtcgcgccacccggatgttgttcctgacgataatactcaccgccatatgtcagtaagtgagaagcgaaactgtcggcaaatagagtggaacggttctccagccttgctccttttgttatctgttcacgatactcgcctgaactccccgtgttttgcgcattaatacggacttccgaccagtaaatttttgcatctgcatttaaccagtcgttaccctgcggggcgagtttataagaaagctgcgcatcgcgttgaattgttgaacgatcgaccatcgggttgctgctatcagaagcttcaacggtctgcggattttttggttcacgcgcgtcgttgttgtagtaacgcactaaaccgctcagagactgggctgaatcaatttgccaggtccctttcgccagcatgttattaatggactcgtcattcggcgcggtttcaccattgctctggcgtaaatcaccccgatcgcgactggaccaggccacaataccatccagattttcagttcgcccaaacgcgctcgcgcctaatcccaggctatggtcccccgtgccgccagtaccaaagacacgaaaaccactgctttgtccttcctgcaataaatcttttgcatcgaccgtatcgtaggagatcactccacccagcgcgccactgccatacagtaatgctgaaggtccgcgaacaatctcaacacgcttgatcagcgccggatcgagaaaagtgccattcaggtgtccggtatccgttccctggcgaacaccatcgacaagaaccagcacgccgcgatgatcatagccacgcatatttacatcctgaccgttggttcgtccggtaccatcaagagtaattccaggaacataacgcagcaaatcagtggctgaagtagcagtttgattttcaggagcggaagtgtcgataacgctgaccatcataggcgcttcgaaggaactacgtgcattccccgttgccgtaacggtcatggtttcagtagcaaaagcaaacgttggcaaggtggcagaaacagccaaagccaacaaactcaaacgcaacgaggtaaattgcggacgtgacatagcgattctccatgaggaaaataaaaaatgctggctgcctgggttaataccggggtggctggcgaaaaataaatttatttacaattcaaatgattagatatcaccacgggaagctattagcgtatatatcccgtaaaattgccgaatatttctgataattcagcaaaagcacgccctctttgtcaggcaaagtagtacgccacgtctgaagtgaagggtgctgtgcgttttcccttacaaaagatatgattttgttatccatgatgtcatattttgttaaactcaaacgtgataatgagaattattatcgatcaattttttatgatcaagctttttttaaccgccattaacacaataaacagggggttatgaaatctatccagcatccagaaaaccatcctgtgtttatggctatccccccacaacctcatcacaaaacgttgtcgttaacagtgataattttctcttctctttgctctgcaagccgcgatatctccgggttctcagctttttcccgcgctgaaatttaatcggtaacaagaacattagctgacgaagcatcttgataaaaatcaaaaataaatacgcttgtaacgccgtgcgtattgaatcgacggttgtatttcatatataactcaaatgataatcatgatcattctcaatttgataagagttctcacattatgccaaggatcatcaccaggccgtttcttttttccccactaacgttatgtatttcagccgtggcctctgccgcgaagaccatggtaaaacgaaaaaaattgtttacggcattactggctcttagctggacttttagcgtaacggctgccgaacgtatcgtggtcgcaggaggatcgctgacggagctaatctacgcgatgggcgctggcaaacgcgtggttggtgtcgatgaaacgacatcctatccaccagaaaccgccaaactgccgcatattggttactggaaacaactcagcagcgaaggcattttgtcacttcgcccggatagcgtaattacctggcaggatgcaggaccgcaaattgtgctcgaccaactgcgggcgcaaaaagtcaacgtcgtcactctgccgcgtgtaccagccacccttgagcagatgtacgccaacattcgccaactggcaaaaacgttacaggttcctgaacaaggcgaggcgctggtgacacagatcaaccaacgcctggagcgagtacagcaaaacgtggcggccaaaaaagccccggttaaagccatgtttattctctccgcaggcggaagtgcgccacaggttgccggtaaaggcagcgtcgcggacgccattctttcgcttgccggagcagaaaacgtcgctacccaccagcagtacaaaagctacagcgcggaatcgctgattgcggctaaccctgaagtgattgtcgtcacctcacaaatggtcgatggcgatattaatcggctacgttctattgccggaattacccacactgccgcatggaaaaaccagcgcattatcaccgttgatcaaaacctgattctgggaatgggtccgcgtattgctgatgtcgttgagtctttacaccagcagctttggccgcaataaatggatttaaatcagacgaatgaacacaaataacaccctggatctcacgccacattttgctttagacggtgatcagccctttaaagacaggcgcgccatgatgccgtttcgtggggccattccggttgccaaagagcaactggcacagacctggcaagagatgatcaatcaaacggtatcaccacgtaagcgactggtttacctacacattcctttttgtgcgacacactgcacgttttgtggtttttatcagaaccgttttaatgacgatgcgtgtgctcattataccgacgccctgattcgtgaaatagaaatggaagcagacagcgtattgcatcagtctgcccccatccacgcggtctatttcggtggcggtacgccttccgcgctttcagcacacgatttggccagaatcatcaccacattacgagaaaagctgccactggcccctgattgtgaaatcactattgaaggccgggtactgaattttgacgctgagcgaatcgatgcttgccttgatgctggagcaaaccgcttctcaattggtattcagtcgtttaacagcaaaatccgcaagaaaatggcccgcacctcggatggcccaaccgctattgcgtttatggaaagcctggtcaaacgcgaccgtgccgcggtggtctgtgacctgctgtttggtctgccgggtcaggatgcgcaaacctggggagaagatctggctattgcccgcgatatcggtctcgacggcgtcgatctctatgcgctcaatgtcctgcccaatacaccgctgggcaaagccgtggaaaatgggcgtactaccgtgccctctccggcagaacgtcgcgatctttacctgcaagggtgtgattttatggacgatgccggttggcgctgcatcagtaacagccactggggccgtaccacacgcgaacgcaatctctataacctgctgattaaacaaggtgccgattgtctggcctttggttccggagccggcggttcgattaatgggtactcctggatgaacgaacgcaatcttcagacctggcatgaatccgtcgcagcaggcaaaaaaccgctgatgatgatcatgcgtaacgccgaacgtaacgcgcagtggcgtcataccttgcagtcgggcattgaaacggcgcgtgtaccgctggacgaacttacgccacatgccgaaaaactcgcgccgttactggcccagtggcaccaaaaaggcttaagccgcgatgcgtcaacgtgtctgcggttgaccaatgaaggtcgtttctgggcaagcaacattttgcagtctcttaatgaactgattcaggtacttaatgcgccagcaattgcgcttgaaaaaccataacaggagtgatttatgagccatgtctcgttacaggaatttttgaaaacggagccagacggtacgctggaggcgatcgccgaacaatacaacaccacgctgctggaggtagtgaaaaatctgccctctccgactgttgtgtcaggtgataaattcgatactgtctgggataccgtctgcgaatggggcaacgtcaccacgttagtacatactaccgatgtaatactcgaatttagcggcgaactgccttcgggtttccatcgccacggctatttcaacctacgcggaaagcacggcatgtccgggcatatcaaagcagaaaactgcacgcatattgccttgatcgaacgtaaatttatgggcatggataccgcctctattctctttttcaataaggaaggcagcgcaatgctgaaaatcttcctcggtagggatgatcatcgtcagctcctgagcgaacaagtcagcgccttccatgctctggcagcatcgttaaaggaacacgcctgatgacaccgtggctactctttggcgcaggcggaaaaggtgtgggtgccagaacgcttgaactggcgctggcggaacaacgtccggtcgttgctgtcattcgtcatgccgatgccgccacgaaactggcgcaacaaggcgtacaggtttttacaggcgacgcctgtgatgccagcgtagtcgcggctgcttgccgcgcagctggcccggatgcgcttatcatctcaacaatgggcggagctcaggattatctggcgcacagaacagtgattgacgaggccgagaaagcaggcatcacacgcatgattctggtgacgtcactgggatgcggcgatagctggccgtttttatcagagcgggcaaaggctgcgtttggtcaggcggtacgggaaaaaacgctggcggaaagctggttgcaaaccagccagcttgattatgccattctccgccccggcggtctgcttgatggtgcggcaacgggcaaagcacaacggatacaaaatcaggagtgtcatggttttgttaaccgtgctgatgtcgccgcacatatccatgaactggcaaatgcgccagcacttaaccagcaggtctacagtctgattgaaccggacctgaaaccggcgtgatcccccggcgcggtatgtccgcgccgtaatgtcgtaacggagttttgcgtgctcaaggattcactctcttccgccaggatctttatggggctatcactattattgctagctctggtgctgtttggtgccagtcagggagcgttaaagatcagttttgatgccctttttgatgaggaataccgcgatatctggctcaatattcgtctaccacgggttttgctggcggtgctggtaggtgcagcgttggcaaccgcaggggtaattatgcaggggctttttcgcaacccaatggctgaccctggattacttggcgtcagtagcggttctgcattaatggttggcgttgctattgtgctgcccttctccttcccagtggtgctggtgctctatgagcaaatggtgtttgccattgccggaagtttagtggtctgcaccatcatttttctcatcacgcagcgccatcgcgatggcagcatgatgcaattattactcgccggtatcgccatcaatgccctgtgcggcgcagcgatcggcatcctgagctatatcggcgatgagcagcagctacgacaactcacattgtggatgatgggcaatcttggacaggcgcaatggccgacgttattggttgccagttcattcatcctaccggccattatcgcaacaacttgtctcgccggaacgctgaatttactgcagctcggtgatgaagaagcccactacctcggcgtgaacgtgaagcgtaaacgccagcaattactgttagtgagctcactgctcgttggtgctgccgtatcggtaagcggtattatcggctttattggcctggtgatcccgcatctgattcgcatgactaccggggcaaatcaccgctggctaatcccttgttccgccctcgccggagcctgtttattgctgatggcagacacgcttgcccgcacgctggtacagccagcagaaatgcccgtgggattattaaccagcctgcttggtggcccttattttatgtggttgattctgcgcaaccggaggatcacatgatcagcgcccagaatctggtttatagccttcaggggcggcgtctgactgataatgtctcgctgacttttcccggtggggaaattgttgccatcctcgggcctaatggtgcgggaaaatctacgctgcttcgccagctaaccggctatcttcaacctgatagcggcgaatgtcggttgtttaataagccattaaatgaatggtcgattactgaactggcgaaacaccgggccgtgatgcgtcaaaatagccacatggcgtttccattcagcgtacaagaagttatccagatggggcggcatccgcatcgtactggtaatcaggataatgaaacagcacaaataatggcgttatgtgactgtcaggcgttagcaaaccgcgactatcggcaattatccggtggtgaacaacagcgcgtgcaattagcgcgcctgctggtgcaactctgggaacctactccctcaccgaaatggttatttcttgatgaaccaacttcggcgctggatattcaccatcagcagcacttgtttcgtttattacgccagttagttcacgaacggcagttcaatgtttgctgcgtattgcacgatctaaatcttgccgcgcgttatgcagaccgtgttgtattaatgcaaaaaggaaaggttatcgcaaatggtaagccgcaggacgtattgacacagcaggcgctgacaatgctctacggcgcggatattaccgtacttaaagatcctgccaaccattcaccactgatcgtcctcgatcattaaaaccaacaggagtaccgcactggtactcctgcgaataaataactatacagattagctaattgaaacgcctttcacccctgccataccttttaataatcgcaacagatcttctatcgacgttgtggcatgaagctggatatcaatggcgaccacttcatgatcttcattttcctgcaacgaaactaaatccgtttttattttttgctgcttaaaccagtcgagcattgataccgtattaccgttcactaatgtcagctgtaaatggtaatttttgttcatcaggcggaaggttaattgatggaagacttccagcaccagcaaggtcatcactgaaccataaatacccagttcgtacataccgctgccaataaccataccaatggcggcggtcacccagatatccgctgccgtcgtcagacctacaatattttggttacgaacgagaatgttacctgcaccgataaacccgacgcccgtcacaacctgagcagcaatacggctgggatccagtccgacgtgacctaaagacagcacgtcagcaaaaccatatttcgaaacaatcataaacagggcgcttcccatgccaattaatacatgtgtgcgtaaccctgctcctttgccgcgcatttgcctttccatgccaatagcgccacaggcaattaccgcaagtataagtcgtataataaattctgctgtcatataaaaatgcaaaaaggagcagcaagatggctcaacttgctactcctttttacttgtaccttattaattcggcaagtcattagatgcttgatttttgaaggtatacaaatttttctgcgggtttttcttgcagtattcgatcactttaggaatttgagtgagatcggtttcatttaaagtaacggtatcgccacctttatatactgtttcttcatgcagcatccaccacgcaactggtgtcattgcttttggattcagatcaataaattcctggcaggtcatatctttagcggattcattggctgccagcgcagattgtgcgttcaccagtgacaaagccgctacagcgcccataaaaataaacgctttacggagagatgaaatgttcattttgtaacccattcaatatagagattatatacaaacaggaggaatagctgcttttaaagaagatattccggcctgttcaatatgcaaggaaatacgatgtaacgcattcccggaattacatatctttcttaattttgtcccattcgcctttaactttatctttaaagctggcttttttatcctgagtacaagcctgaacgatagctggggttacggttgcaataccctgaacatctaaaaccgcatcttctggtttatctttgttgttcagtgcttcagcaaaaccaactgcagttggctggaaggattcgtccacagccaggaaatcttcacaggtccaggaattgaccggttttttgttatcagctgctttttgtgcatccgctgcattgctcactactggcagaagaagcagaccaccaagaataacgcctaatacttttttcatcgtaatatcctcaactataaagtgaaagagccgtcacgaatcaatttcgacactgaggttataacctggttttctgtatatgtcatgttgatggaaaatatcaaaatcagatatttttatttcaatacaatgagttacagacgcatcagatactgtaattaggaaatttttattaaatcgactgcattcttacacgcgtttttggcatagattgatagcaggggattttcttcttaattttatagggtggttctatgttatatatagataaggcaacaattttgaagtttgatctggagatgcttaaaaaacatcgcagagcaatccagtttattgccgtgctgctgtttatcgtcgggttgctgtgtatcagttttccgttcgtctctggcgacattttaagcacagtagtgggtgcattattaatctgctcgggcattgcgcttattgtcgggctattcagcaaccgcagtcataatttctggccggtattatccggtttcctcgtcgcagtcgcctatttattgatcggctatttcttcatccgcgcaccagagctgggcatttttgccattgcggcatttattgccggtttgttctgtgtggcaggggttattcgcctgatgagttggtatcgtcagcgttcaatgaaaggcagttggctacagctcgttattggtgtgctggatatcgtcattgcctggatattccttggtgctacgccgatggtgtcggtaacgctggtttccacactggtgggaattgaactgatatttagcgccgccagtctgttcagcttcgccagtttgttcgttaaaaagcaataattatccctatttccacctggatcatagtcacattaagtgactatgatccagttaatactctcttagctatacagtgtttcagttcaattacgcactatcattgaaacaattgcctgctgttgattatttcaacctactgaatttaatctgattttttttcgttccatggcaaattagccatttcaaacattatcatggctgatattttccgtggtcaggtttaatgttttaaaagtgctgtgggaaagtgaacaaagagttccgtaagcgttgatgctatgggcggttaaataagtaatccgggttcatttttttgcaactggcgttgattacattgcataaatatccgtgtctccagacgctatataaaaacctgaagacatgaatgagttatttaatcaggtaatttcaatgcgttaaaagaaagctggcaatccaattgccagcctaagtcgaaacaaggagactcgatatttaaatcggattacattttaactttagtaatattcttcagagatcacaaactggttattgataacttattcttgggcagtaatccgcaaaagttaaccttttgtttactagttacaaactgataacaaccaggaatcttacttaggaccaatatatggagtgcgtgatggataaatctgaagtattgattagtgttaatagacgtattagttcacgaagggcaaagttcttataggcgtttactatattgaacaacgattcggacaaggatgtaaataatgaaaaggatgacatgttcgaaacgataacggctaaggagcaagttatgatttttctcatgacgaaagattcttttcttttacagggcttttggcagttgaaagataatcacgaaatgataaaaatcaattccctgtcagagatcaaaaaagtaggcaataaacccttcaaggtgatcattgacacctatcacaaccatatccttgatgaagaagcgattaaattcctggagaaattagatgccgagagaattattgttttggcaccttatcacatcagtaaactaaaagctaaagcgcctatttattttgtcagccgtaaagaaagtatcaaaaatcttcttgagattacttatggtaaacacttgccccataagaattcacaactatgtttttcacataatcagttcaaaattatgcaactgattctgaaaaacaaaaatgaaagcaatatcacgtcaacgctcaacatttcgcaacaaacattaaagattcagaaattcaacattatgtacaagctgaaattaagacgtatgagcgacatcgtcaccctgggtatcacatcttatttttagtaaggacataagcaactgaaattgatggctggcatgacgagggatgcagatgctgatttcaatacccccggtgattattgaaggagagacgaaaacgactttattcccctggtatgtgtatccaccagtagaacccttcgttgcccgaatgctggcagaaactgttggcagaacggcaacattttttttgtcgttgacctcaccatgtcgatcactgtgcttgcatcccatcttactggctgacaaccccactatgccgctggtctgtaaatccctcatatctctcctcgcgcgcaatttaaagaaccgttatttctcaagaattttcagggactaaaatgaacagaagaagaaaactgttaataccgttgttattctgcggcgcgatgctcaccgcctgcgatgacaaatcggcggaaaacgccgccgccatgacgcctgaggtcggtgtcgtcacactctcccccggttcggtcaatgtgttgagcgaattgcccggtagaaccgttccttatgaagttgccgagatacgtccccaggtgggcggaattatcattaaacgcaactttatcgaaggcgataaagtgaaccagggcgattcgctgtatcagattgatcctgcgcctttacaggctgagctgaactccgccaaaggctcgctggcgaaagcgctctctaccgccagcaatgcccgcatcacctttaaccgccaggcatcgttgctgaagaccaactatgttagccgtcaggattacgacaccgcgcgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaggatttcttgcgcatgaaagaagaggtcgccagtgggcaaatcaaacaggttcagggcagtacgccagtacagctcaatctggaaaatggtaaacgttacggccagaccggcacgctgaaattctccgacccgacggtggatgaaaccacgggctccgtgacgttacgggcgattttccccaacccaaatggtgacttgctgcctggcatgtatgtcacggcattagtggatgaaggtagccgccagaatgtattactggtgccgcaggaaggcgtcacccacaacgcccagggtaaagcaacggcactcattctggataaagacgatgtcgtgcagctacgcgaaatcgaagccagcaaagccatcggcgaccagtgggttgtcacctctggcttgcaggctggcgatcgggtgatcgtttccggtttgcaacgcattcgtccgggtatcaaagcacgtgcaatttcctccagccaggaaaacgccagcaccgaatcgaaacaataacgttgcaggcttaaggggactttcatggctaactattttattgatcgcccggtttttgcctgggtacttgccattattatgatgcttgcaggcggtctggcgatcatgaacttaccggttgcgcagtatccgcagattgcgccaccgaccattaccatcagcgctacctatccgggtgccgatgcgcaaacggtagaagactcggtcactcaggtgattgagcaaaatatgaatgggcttgatggcctgatgtacatgtcttcaaccagcgatgcggcaggtaatgcctccatcactctgaccttcgagacggggacatcacctgatatcgcacaggttcaggtgcaaaataaactgcaactcgctatgccttcattacctgaagcggtgcagcagcagggaattagcgtcgataagtcgagcagtaatatcctgatggtagcggcatttatttctgataacggcagcctcaaccagtacgatatcgcggactatgtagcgtctaatatcaaagacccgctaagccgtaccgcgggcgttggtagcgtacagctctttggttccgagtacgccatgcgtatctggctggacccgcaaaaactcaataaatataacctggtaccttccgatgttatttcccagattaaggtgcaaaacaaccagatttccggtggtcaactgggtggcatgccacaggcggcagaccagcaactgaacgcctcgatcattgtgcagacgcgtctgcaaacgccggaagaatttggcaaaatcctgttgaaagttcagcaagatggttcgcaagtgctgctgcgtgatgtcgcccgcgtcgaacttggggcggaagattattccaccgtggcgcgctataacggcaaacctgctgccgggatcgccatcaaactggctaccggagcaaacgccctggatacctcgcgagcggtgaaagaggagctgaaccgtttatcggcttatttccctgcaagcctgaagacggtttatccttacgacaccacaccgtttatcaaaatttctattcaggaagttttcaaaacgctggttgaggctatcatcctcgtcttcctggtcatgtatctgtttttgcagaatttccgcgccacaatcatcccgacgattgccgtaccggtggttattctcgggacgtttgcgatcttgtcggcggtcggtttcaccatcaacacgttaactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcgggattgccgttgttctttccgcagtgtttatgccgatggcctttatgagcggtgcgaccggggagatctaccgccagttctccatcacgctgatctcctccatgctgctttcagtatttgtagcaatgagcctgacccctgccctgtgcgccaccattctgaaagccgcgccggagggcggtcacaaacctaacaccctgttcgcacgcttcaacacgctgtttgaaaaatcaactcagcactataccgacagcacccgctcgctgttgcgttgtaccggtcgctacatggtggtctacctgctgatttgcgccgggatggcggtgctgttcctgcgtacgccgacctctttcttaccagaagaggatcagggggtatttatgaccaccgcgcagttaccttccggtgcaaccatggttaacaccacgaaagtgctacaacaggtgacggattattatctgacaaaagagaaaaataatgttcagtcggtgtttaccgttggtggctttggcttcagtggtcaggggcaaaacaacggtctggcgtttatcagcctcaagccgtggtctgaacgtgtcggcgaggaaaactcggttaccgcgattattcagcgggcaatgattgcgctaagcagtatcaataaagccgtcgtcttcccgttcaacttacccgcggtggctgaactgggtaccgcgtcaggttttgatatggaactgctggacaacggcaatctggggcacgaaaagctgacccaggcgcgaaacgagctgttatcactggcagcgcaatcaccgaatcaggtcatcggggtacgcccgaacggcctggaagatacgccgatgttcaaagtgaacgtcaacgctgcgaaagccgaggctatgggtgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctattcgtctaccgaatggacctatggttcaccgcgactggaacgctacaacggcatcccgtcaatggagattttaggtgaagcggctgccgggaaaagtaccggtgacgccatgaaatttatggcagacctggtcgcagaacttccggcaggcgtcggctactcatggactgggctgtcgtatcaggaagcgttatcctcaaaccaggctcccgcgctatatgccatttcactggtcgtggtgttcctcgccctcgccgcactttatgaaagctggtcaattccgttctcggtgatgttggttgttccgttaggcgtcgttggcgcattactggccaccgatctgcgcggcttaagtaatgacgtttacttccaggttggtttgctgaccaccatcgggctttccgccaagaacgccatcctgattgtcgaatttgccgttgagatgatgcagaaagaagggaaaacgccggtagaggcaatcatcgaagcagcgcgtatgcgtttacgcccaatcctgatgacttctctggcctttattctcggcgtgctgccgctggttatcagtcatggtgccggctctggcgcgcaaaacgcggtaggtaccggcgtaatgggcgggatgtttgccgcaacagtgctggcaatttacttcgttccggtctttttcgttgtagtggaacatctctttgcccgctttaaaaaagcgtaacgtgtaaatgagagtaaggttgaacgtgagggttcagccttactctttcctgctaaccattcaccactcaacaaccagctaaccgtcaggaataccaggcttagtacacagcactgaaagtagaaaccactccagccattcgtcatcaatttgaacagcacaatactgacccacattcccgtaatcgtatgaattgttagcttaataatcccaaacatgccgagtcttttcctcctgaaaatacctataccgcctggcaaactgcgaaagagaactagccggtagcccggcagaaatcatcaggaaagagtttcacatgaagcagacgtgagatcctgaccaatattcaaatgcgaaatatgtcaggaaaaggtacccggcgaatgttgcgaaaactgatgtggcgttacaccataatattgtctaaatgtatttataaagtatgacgtactgctatagccacatttttccgcaatagtatgcagaggtatttgacgtaactcgagtaatcgtctggccatcgacatcctggaggcgagtaatattttactgaaacaggtattttcatcctgcaacttttttttgatgagactctcgctggtatacattctttctgcgatatcgcgtagataccaacgtttagcgatatcaaagctaataaggcgttcaacttttcctgaaacagtactgatactattgaaaagtaaggggatcagttcttttttatgagaaaacattgataaacaggaaagatagagcattttgctcagtatcggcgaattgacccgggggtcattgaaactatcaaaaatcgccgtcaccagctgtatggggggtgactggttaattaataaacggtctttgctatgcaatcctaaattacgtggcaactgacgaatattttgtaagtaatggcaaactgtcagctcttcgatatccagccgtcgcgtatccagtgaacaaaacgcaaaatcgtctgccaaatttttatccagcagcaggatactctcgttatgcaacgatattttttgctgttcatgatgaatatcgaatgaacgacgaacgaggatcaccgagcagacatgagccatgactatcccttatatttcattactgcgattatttcaatgtcagtatactaatgaaatgacgccagactgtttctgtgtgcaaaaactgccatatttggtaggaccaaattttatccacaaagtagttttgcataacagttaattgataataagtaaatgcaacacgattatattttcacacagcgtatagcttatgtttataaaaaaatggctgatcttatttccagtaaaagttatatttaacttactgagagcacaaagtttcccgtgccaacagggagtgttataacggtttattagtctggagacggcagactatcctcttcccggtcccctatgccgggttttttttatgtctgagtaaaactctataatcttattccttccgcagaacggtcagtgccgtaaaaaatcccttgcgcagccatacttgccgccgggccacagttcggtaattcctgcgccgatcgctcctgatactctgtgggcgtcatcccataataatttcgaaaaacgtaaatgaaatacgacacgctgtgatatccacaggatactgcaactcgcttaattgaaaccccatatataacaataagttgtaaagcacgctgcatcctacactcagtaagcaactgtgaatatgacgtaccttcttcgcgcaattttttctttaacaggcttggactcatcaacaattcgctagcgattcgggctaatgtccactcatgggcgatattattattgatgaccgtacaaactcgtgttcgcatattcggttgcaacacgttcagaagtaacggtataaactgcgtatcctcaagaaaaacagataacaacgcaaagattaatgcccttttacgtagcatttctgcatagcgaagattcttattctgcgatagttgcgcaacttcctgaaaaacaggaatatctctggtacagtgatgaacgagtaatgaaggaacttttttatgtgcatgaagttttaatgcctcctccttgagcatcgggagaaataatgaaagcgtgtctcttgaaactaatacgaaattctcaacacacttatccacttgaatttggcttgcatccgcaaaaaccagatcaccgccattaaaatagcgatattcaccattaaccatggtgagaatatatttatgtcttgcgtacgcaattagacaattaccatgtagtggttgcatagttgacttaatattacataaacatattactgtttattaatgtagcacgccgccctcttaagtcaaattgattgataaataaatttaaacgaagcgggaaaacaggatgataatgagcgatgatactcgggctggatgactggatttattatataaaaaggggacttaagaacgaagaggaattaatagttagcaaataattcatcatcgtaatattaagcagtatcgctatgctccataacattcatataacatatatcttatcaacacgatgaatagacaggtaatatattattgcaattaataagtagccgaatacccacctgtttttaaaggttgggcattcggtttttacaacgtgatgttatcaggtgtgtttaaagctgttctgctgggcaataccctgcagtttcgggtgtatctgacccatgatgaacaggaactgtttgaagtcattaataaaaaattactggcgcatcttgatgatgtcagctcataaagcgtgaaatgcctgagtatgccggatagcttcaggcaaaagaataatgattcttgcagatgtgtttttccggatacaaaaacaaatgataaaaattgcagcgccaggcatctttcaaagcagggagacctgtaccgcgtcgaaaatttcagccagttaatatcattgtctgaaccaggcactttgcccgggcaggagaaggagttgtggcggtctcagcccggaacaatttgaaaaccataatctcgcttagggccgtgtccacattacgtgggtaggatcactcctggattttctctttttggacattgacgtctccattggtttaaacacggtaatggagactgcggtgaaaagagttaattcccggagtgactggctggatgccaatcaatgatcggaagcatgctaaactgtgaacggagatggatgccgccaaatcatgatcgattcagatgccatatttgcaatatcgcgttaatcatcagttcagccgggatatattagcgggccagggatccgggaaaacgccacctgattgccaccagacaatttcttcttcagaaagaaaacagttaattaaggcggaggtaaaatcatggacttcatcagaacgccctataatcgttaaatggcatctcctgtctccaaaccgccccagagttttattgacttttttctgcaaagcagagcgctcttcgtgggtcaggtgattatcaggggctgccaatacaccggaattccagtagctgataaactccagattgatgcttcctgcggcctggttccagagcagagccatgtcaggtcttcctggtagccagaaaaagcctttattacgataattacgtagcgttcagtgatgatctgctaataatattctgtcgatccgctaagtgtcagtgtatgcggtaagcccgcccttgagtcactatttggcaactgctacatctaaggtgacgttattcgctggcgccgatattttctcgatgggagataaccctgcacactatgcagtgtaatactcgagctactgcaaggttacgcaattcagtctttactgccgttcttacattcgatttgggtatgaaggctttcatcgttttaacacctttctgcaattccattgttctgagagctttccaccgctgttgtacaaggtatatggcacagttgtgtcattaacttctgtatttcgtcagtgagaacccggtgattacgtagttcatcttttgtccagtggattggttgccgtataaaggatcttatcaacaaagcacagttcctctatgtcagcgacgacgtagtgctatggctctttcccaaacgcccatttctgactgttcctgcaacgccggttagctgtcactatttttatggattcgataaaaaatcttcatcatgtatgatcgattttgtcgatcgattcgatcgaattttctccttttaccctgccttttgcatggttttaaaataggcaaaattacttgtcattcgtggaaagtgatggcggagataactgagcttaaaacgtttctcttgtctccgtcacttgccataccagccaggaaaagaagatgtcagcacaagaaaaaacagtacagattgattcttttgatgcgaaatttttagatataaatacattaagcaggcttatttatgaacgtaagagttttgtgatcgaaaatgtttccgatgttagtgaaacggtaaaaagagtggagcatgaaatagagaaaacgaaattaagttgtcgtgtatatactgagtacaggagtacagctttagctggttctttatggtcaccaaccgtaattctgggagtggcgagtgcagtagcaataggtgttcataatttatctacatggaaccccgattatgaaatcggtaagaactatattaaacggagattatcggtaaaatataaaaaggcagaagtattgtgatcggttactccagtgcccctgcctgtttgtattctggggaggttgtattcacataatttcagacaggcgttcacgtcctcactgagaagatatatttattttgtgtagagtaaaagtctggcttccgtagtgtggagtgttgaggctgcctttagtccggtttttaaatattaaaaatatatattaaaatgatgatacaataatggagataattgaaatgaataaggtttttgttgtttcagtggtggccgcagcctgtgtatttgcagcaaatgcaggagcaaaggaaggtaaaagtggtttttatctgaccggtaaagccggtgcctctgtggtgtcactttcagaccagcgtttcctgtcaggagatgaggaagaaacatcaaagtataaaggcggcgatgaccatgatacggtattcagtggcggtattgcggccggttatgatttttatccgcagttcagtattccggttcgtacagaactggagttttacgctcgtggaaaagctgattcgaagtataacgtagataaagacagctggtcaggtggttactggcgtgatgacctgaagaatgaggtgtcagtcaacacactaatgctgaatgcgtactatgacttccggaatgacagcgcattcacaccatgggtatccgcagggattggctacgccagaattcaccagaaaacaaccggtatcagtacctgggattatgagtacggaagcagtggtcgcgaatcgttgtcacgttcaggctctgctgacaacttcgcatggagccttggcgcgggtgtccgctatgacgtaaccccggatatcgctctggacctcagctatcgctatcttgatgcaggtgacagcagtgtgagttacaaggacgagtggggcgataaatataagtcagaagttgatgttaaaagtcatgacatcatgcttggtatgacttataacttctgacgacactgctcctgaacgataattgcgtatattctgtaattaagataattgcatatcttctgcaattaaacagaaataccctgcagtctattactgcagggttgtcttttatctgttttacagataatttctgatttttattatcctgttctcttcataataatgttgtcgatatactccgatgaatatcagaaaactgttttgtccgggcaacaccccccggattttattgtttttattcttttttgttgtttctgcaataaccacaattgcatgcggatacactgagaagaatgcaacaggaaatgtgctgcttctgtttctccttctgctccttgcacacagaaataccctcacatccattacagcgctgttatttctgttctgttgtgcactgtatgcgcctgccggtatgacgtacggtaaaatcaacaacagttttattgtcgcgttgctgcagaccacaactgatgaggcagcggagtttaccgggatgattcctgtttatcattttctggtcagtgccgcgattctggtattcatggtgattttctggcgaacacaccaccgcggtcaccgtaactggctggcactgctgctgttcgtattatgctcagtaaacagctggccgttgcggatggttaaaggaactgttgtggggacaactgacacattgcgtgaaatgcagcattataaacaactgagtcagcacggggctgacaactggaaaatcctgccgggaacaccgttatatgacacgattgttattgtcactggtgagagtgtgagcagggattatatgtcggtatatggctatcccgtgccaaccacaccgtggctgaatactgctcccggtttatttattgacggctatacatcggcagcagccagtaccgtaccttccctgagccggacactgatttatgactatgagcagaaccctgactccggcaacaacatggtggcgctggcagcaaaagcaggatacagcacatggtggatatccaatcagggaaagctgggggagcatgatacacgcatctctgttattgcttctgatgcggagcataccgttttcctcaagaaaggcagctttgcttcccgtaaaacggatgacatgttgttgttacaggaaacagaacgtgcactggcggataaatcctctccgaaggtgatattcctgcacatgatggggtctcatccgaacccgtgtgaccggcttcactcctggccgaataattaccaggagcagttcccccggaagattgcctgttacctcgccagcatcagtaaactggataactttctcgggcagcttgatggtatccttcgccggcattcccgtcattttgccatgctttacttttctgaccatggtctgtcggtcagcgacagtgctaatcctgttcatcatgatggtcatgtgcagggaggctacagcgttcccctgattattaccgccagtgacatcacgtctcatcagtccgtcagcagaaaaatcagtgcccgtcatttcgcaggtatttttcagtggctgaccggcattcgtactgaaaatataccgccattcaatccgctgacagacgaagataatgaacccgttatggtttttaacggggagaggaatgtaccggcagacagtctgaaaccgcagcctctgattcttccggacagaagataatcatgtcggtatgaatgttataattaaggaccgtgcaataatagccattccattcagccatcttacgctcgaaaacaatcggtaagatggctactcaccattcctgctctaaacctgacgcctctcaagactattataaatagcctcaacctcacccttcaggttatcaccgcaataaaccattgaggtatcgtatcgttcatatcgcgcttcccgtgtcgcactaaaccagttgaacgatcccacgcacagcaaaccatcatcaccaataacaattttgctatgaacacggtttaccagctttgtagcaatacccagcgcattcagtttctccagcgccgctttaaagttttgctgcttctcttttcgcttctcaaaatcattatgttcagtgttgtagcttctgtcagtgactatcgtgacgttaactccacgtgaacacgccgcaatcatggaatcaagaaaaccggtttgctccagcctttgccaggtcagccatggagaaactatcatgatgtgtttactggtattttcaaatgtctgattcaggaaattatcatgttgctccacaccatgaagtgtgtagattttggtcccggcggtttttaaatccttacgctctttataatcaaaagagagcgcattcttctctgactcaaagaggtattttgccagtaatccccgtggagatgaggctggctggacctcaaacaggtccatatcgccgaagaccagaaaactgtccttcgcacgggagactgcaacattcagcatgctgttatcgctatcaataaacccgccgtcttcatgttttgaatagactggcgagaatatcacaatcgctctttccgctccctgaagagagtgcacggtgcccactgtgagcgatttttcattcgcgcctgtactgataccttgtttgcccagcacctgtttgatagtggatacctgagcgctaaaaggcgtcacgataccgacaacttcatgaagcgatttaccgtaatgcgcttcaatattttgctggttctctgccaaccagaccgctatcgtttcagcctcaagcaaattatatcgacttccactacttgccagctcacctttaccatcaatatggagataccccatttcgggcattaaattgctctcttcacgccctcttttaggcaacaacttaccgtgatagcagagcgtattacagtatccaataatattgtcgtagcaccggcggtgttcatataggtacataccacgagccagttcgggatcatattgatagcgtgaagcaaactgcgctattttcataacgctgccagatgcggcacttttaccaaggtctgcgattgccgtatatttctcggtaatctcttcttgcgtactgccagacagaattttttccgccagcatgttaccgacatcaatcgcaggagcaatactccatattggcgggagctgctccgtatcgccaatcactaatgccttcttagctaatgcaaacgaggcagcagccacttcaggaagcacctgcccggcttcatcgacaatgagtaaatcggcaaaatcatacaaataacttttctcgaatttacgctgtcctttgtgctcacttatctgcatattgccgggcagcatatagcatgtcatcaccacacatggagtgagtttcattcgacgttgccaacgggcggttacccctttagcgccttttttcttcttctcttcctgcagatcatcaatgctggccatatccatcagccaacgaccttcccagtagtgagtcgtcagtaaaaatgcagggaagcgaatctgcgtatcagccagttcatcggcctgtgagaagctcagttcctcgtcgccctcataccctaaatcaagagccagtctctgccactcctgaaccgcctgctgttctttaagaatgatttcatgggcggagtcaatctgctgccggtatgttgtttgctcgcgctcagcggaattgagcagcccatcaatattacgttcgatagtttcaggatcagaccactgatttcctgcaatcagcgcccctaatttatcttcgagaaacagttgtatttggtactgtcgcttactgcgaaccgccgggagccaggaaaataatgaatagatcagtgattcaccggcgcgatattttttccattccgttttagcacttttcagtagagtgattttttgttcttgtccggaaagtaatttatttaaattatcgagatattgctcaatgtcgttagcaataagctcacgcgcagcccatacctggcttaacgtttgccatgttgcgttcagtcttatcagttgctcggattttgctgccaactgaccatgcaggagttcaatgaccttttcaggggatgaacactctttttcaggaaaagctgccttagctttctcgagataaaacagcagtgcatcttctacatactcttttgactcaacctggttgaagaaatcttcagtttgatattttttggctgcttcagctttacggctgcttgagggaaaataagcgccgaagcttttcagctctggcaaccatcgcccggccatcgcacctgaaccttgcgaaaagtctttcccgaatgcctcaataatgttcgttacagcctggttattcgttgaagtcgcgataataaccggaggctcagatttttcgagagccgctctggcccactgcgtggcgatgatagaaagcaccagcgtggtttttccggttcccggagggccattaacagcaaggatatcgccatgtctagcatccagaaaatggcttaaggcatcgcgctgagcctttgccagcggaaacttatctccggagtgtccaagcctgtcgctgaattttgctccaggggccagcaaagactctgcagcatgaacctctcgcgaggcgaagcgattgaagagcggcacatccttattgcaaacaagcaggtgatcataaagagaaaggatatggaaactggcaccgccagattgagccgttttaacaatataaccgtgctcagcgagttcatattgctcaggtttttcaatccagtcgccggcaacgctcttcagtagcctctctgagtcatacagatattgacgccactcctgctgcaaggcggcatatcgtgcttcccgttcttcatccgtttcggcagtcttatcaacgctgtcatcaaagttgatagagaacgtggtatgggtcgtcttgtatttgtcatactgcccaatctcaccaatcgaaaatgctccttttggcaaaggttcaagcaggtctctgggaatggaggtcgctggcgtcggatataaaaaaccctcacggcttagcaaggctggcgtcactatcggggtaacaatatcaggcgcacctgcagaacggtccttaccatgctgcaataaccggaaataaacttttgggcgcaagatgacatcgaccgtttcgacatcgtctttttctcccttaaaaaatttactgacaatcgcttcgtcaagacgtcccgccgctatcccatgccagtgagtgaaatttttggcgtctttccgttcaaaactgccctttcctgactcagcatccgcaagcgagttgcgccagtatgaggtaaaccctaaagcattttcatccattaccagtcctgtgactcaatgaaatccattgatttatcgaatataaaaccaccgtatggacaactattgtccatattgaaaaagttggatgcaatgttttgtttataattcggtatcaaatgtactggttgtacaaggttcagaacacaagcacattcaacagtacgtcaggactattgatttcataacagtgaatacattttttaccgtttataatgactgcctgtgttggacaaggataccagaacagccgaaaacaccgggggttattacctgctctcatggaaaccagatattcctggtgctaatcacagtcataaatagcctgaagaacatgacgaagggactttaatggacgccggagtaacttgtcagaacatcaatcttcgtcatcatttacaaagaaaaataatcagttaaagcagtccgggcaatcagcccggactgcttactattttaatggattgttaatttttgcatagtcaaacggactgatacccttctcccggttcgcatccagaaaatcagcccaccactgtagcatcagtcgacgttcttccagatgttctgctttatggatatacgcagccctcactgaatttcgctccatgtgactcatctgacgttcaacagcatcacgagaccacaaacctgattcgatcaatgaactacaggccattgttcggaaaccatgaccacagacctcaacttttgtatcataccccatgacccgtaacgcactatttactgtattctcactcatgggcttgtgcgaatcgtgatcaccaataaatatcaagtcatgagccccacaaaactgttttatctgctttaaaattgcaagggcttgccttgaaagaggcactagatgcgttgtacgcatttttgagcctctatgggaatgtttcactccaggaataggctcccgctccggtgggatagtccatatagacgcttcgaaatcgatctctgaccaacgagcaaaacgcagctcactggaccgaataaagatcagcaaagtaagttctgtcgcccatcgggttagcggcctaccagtatagctatctatttttgtaagcaactcagggatgcgctttaattcaagcgcgggacgatgttgtcgattacaggaagcaaccgccccagccatctcttgtgccgggttataatcaattaacccactttgcactgcatagcgcatgatggctgtagtacgctgttgaagacgagcagccacctcaagacgtccagacatctccacggctttaataggtgctaataaatctcgagtttttaactcagcaatattacgttcaccaagcgctgcaaaaagattatcttccagactttttagcacacgatgggcatgatcttctgaccactttttattggtgccataccactcgatcgcgacttctttaaaggtccgtgctttactctgttcaaccttatcatttttctttttatctcccggatcgacgccattcgcaagcagcttacgcgcctcgtcacgacgtactctagcatccgctagtgtgatttcaggataaaccccaagtgctagcatcttttgctttccctcataacggtactgcaaacgccagtacttagaaccatttggatggacaagcagatgcataccgccaccatcagtcagcttatattgcttatccgctggcttggctgttctgactttgagatctgttaatgccatgcgtattccctccctgttggtacaagcattatcgaaccggaaataccatcatctgtaccaacatgtgttggtagatgtacgttgatatcagttgaccttgagagagttaatatagctggaaaggtagataaatactgaattttaggcataaaaaagacctcagttgaggtctatttacatacttttggtgccgaaggccggactcgaaccggcacgtatttctacggttgattttgaatcaactgcgtctaccgatttcgccacttcggcactgaagaggtatgcggaaaacgttgtggattatacctgtcgcacgccaccatgcaagcgccagcttgctcgcacctcgctaagtgctgaaattttcagcattgcatacagcgatgtgtaacctttgtcacactccaggcaccccgccctgccatgctctacacttcccagacaacactagagaaggaccaaaaaatgtcgatgataaaaagctatgccgcaaaagaagcaggcggcgaactggaagtttatgagtacgatcccggtgaactgaagccacaagatgttgaagtgcaggtggattactgcgggatctgccattccgatctgtcgatgatcgataacgaatggggattttcacaatatccgctggttgccgggcatgaggtgattggtcgcgtggtggcgctcgggagcgccgcgcaggataaaggtttgcaggtcggtcagcgtgtcgggattggctggacggcgcgtagctgcgggcattgcgatgcctgtattagcggtaatcagatcaactgcgagcaaggtgcggtgccaacaattatgaatcgcggcggttttgccgagaagttgcgtgcagactggcaatgggtgatcccactgccggaaaatatcgatatagagtccgccgggccgctgctgtgtggtggtatcacggtctttaaaccactgttgatgcaccatatcactgctaccagccgcgttggggtaattggtattggcgggctgggacatatcgctataaaacttctgcacgcaatgggatgcgaggtgacagcctttagttcaaatccggcgaaagagcaggaagtactggcgatgggtgccgataaagtggtgaatagccgcgatccgcaggcactgaaaactctggcggggcagtttgatctcattatcaatactgtgaacgtcagcctcgactggcagccttattttgaggcgctgacgtatggcggtaatttccacaccgtcggtgcggttctcacgccgttgccggttccggcctttacgctgattgcgggcgatcgcagtgtctctggctctgctaccggtacaccttatgagttgcgtaagctgatgcgctttgccgcccgcagcaaggttgcgccgactaccgaactgttcccgatgtcgaaaattaacgacgccatccagcatgtgcgcgacggtaaggcgcgttaccgcgtggtgttgaaagccgatttttgaaaatcattcgcagcgctgatctgaggcgctgccctctttcgcacatattctgttttgtcgtatcgccagcacagcctgccgacattgttcggtgacattggcaatatcatggttgatatcaatgcgcacaatatcctgttcatcgtcttgtggacgctccagtgcctcaaactgactttttagtaacgctaccggcataaaatgcccagcccgacgctgcattcgcgcgagaatagtttcatagtcgccatctaaccagaggaaatgaacatgggggctacccttgcgtaaaatatcacgatactgtttttttaatgatgaacagacaataaatcctgtttcattctttttataaagactgtatgaagcatcatttaagcgttccagccagggaagtcgatcttcatcagataatggaataccctgcgacattttatctatatttttggctggatgaagatcgtcaccatcaataaatttagcagataataacgcggcaaccttgctaccaattaatgttttaccactccctgaaacgcccatcaaaataaagctttcacccgccatttaaaatctcctgaatcatcttacctgctgcgatactacgcctggtggcataataatttcacgtttttttatttctgctgataagaattacaaggcacatcacgttatgcgtaacatcgtaatgtaacaattttctaacgtgatcttcatcacaaataatgacaattaaaaccgcttaaatgcttccgaggtgtctacctgaccagtgaggaatttatgcaagtgaaaacacagtcctgcgttgttgcgggcaagaaaactgttgccgttaccgagcagacgatagattggaataataatggaacattagtacaaataacccgaggtggaatttgcggttccgatttacattattatcaggaaggaaaagtaggtaatttcatgataaaggcaccgatggtgttaggtcatgaagttatcggtaaagttattcatagcgactcatcaaaattacatgaagggcaaacggtagccattaatccgtctaaaccgtgcggtcactgcaaatactgcattgaacataacgagaatcagtgtacagagatgcgtttttttggcagtgccatgtatttccctcatgttgatggtggctttacccgttataaaatggtcgaaacgtcgcaatgtgtcccttatccggccaaagctgacgaaaaggttatggcttttgccgaacctttagccgtcgcgattcatgccgcacatcaggccggcgagttacagggcaagcgagtatttatttctggtgttgggcccattggctgcctgattgtcagtgctgtgaaaacactgggggccgcggaaattgtctgtgccgatgtgagtccccgttccctttcactgggcaaagagatgggggcggatgtgctcgtaaacccacaaaacgacgacatggatcactggaaagcggaaaaaggctatttcgatgtcagctttgaagtgtccggtcatccttcatcagtgaatacctgtctggaggtcactcgtgcacgcggcgtaatggtgcaggtagggatgggaggcgcgatggcagaattcccaatgatgacattgattggtaaggagatttcactcaaaggctctttccgttttaccagcgaatttaataccgcagtgtcatggctggcgaatggcgttatcaatccactgcctttactgagtgctgaatatcccttcactgacctggaagaggcgctacgtttcgccggtgataaaacccaggcagcaaaagtccagcttgttttctaagagataaataaaggaataatacaatgaacgatctattttcactggcaggaaaaaatatcttgattaccggttcagcacagggcattggctttttactggcaaccggcctgggtaaatatggcgcacaaataattattaatgatattactgccgaacgcgcagaacttgctgtaaaaaaactccaccaggagggtattcaggccgttgccgcaccttttaatgttactcataaacatgaaattgatgccgccgttgaacatatcgaaaaggacatcggccccattgatgtgctggtgaataacgccggtatccagcgccgtcatccttttactgagttccctgaacaagagtggaatgatgtgatcgcagtaaaccagaccgccgtgttcctggtgtcgcaagcggtaactcgtcacatggttgaacgcaaggcaggtaaagttattaatatttgctcgatgcaaagcgaactgggacgtgacaccatcaccccttatgccgcatcgaaaggggcggtaaaaatgctcacccgcggcatgtgcgtcgagctggcgcgccacaatattcaggtcaacggtattgcgccgggctatttcaaaacagaaatgactaaagcactggttgaggacgaagccttcaccgcctggttgtgcaaacggacccccgccgcacgctggggagatccgcaggaactgattggtgctgcggtgttcctttcttcaaaagcctctgatttcgtaaacggccacctgttgtttgttgatggcggcatgttagtggctgtttaacacctactaccctacgtgcagcgcgaaagcgctgcttttctggcactaataagagataaagactatgccattaatcattattgcggcaggcgtcgcgctgcttcttatcctgatgatcggctttaaagttaacggctttattgccctcgttctggtagctgccgtcgtcggatttgccgaagggatggatgcacaggccgtcctgcactctatacaaaatggtatcggcagcacgctcggcgggctggcaatgatcctcggtttcggggccatgttaggcaagctgatttctgatacgggtgcggcacaacgtatcgccactacgctgattgctacttttggtaaaaaacgcgtgcaatgggcgctagtgatcaccggtctggttgtgggcctcgccatgttttttgaagtgggttttgtcctgctgttgccgttggtatttaccatcgtagcatcatcaggattacccctgttgtatgttggcgtaccaatggtagcagcgctctctgtaacccactgttttctgccgccacatccagggcctactgccatcgcgactatctttgaggctaatctcggaacgactttactgtatggatttatcattaccattccgacagttattgtcgcaggaccgctgttttctaaactgctaactcgctttgagaaagcaccaccggaaggcttatttaatcctcatctgtttagcgaagaggagatgccctccttctggaacagtattttcgctgccgtgatcccggtcatcctgatggctatcgccgccgtttgtgaaattacgttaccgaaaactaacaccgtgcgcctcttctttgaatttgtcggtaaccctgccgttgcgctgtttattgccattgttattgcgattttcacactgggccgacgtaatggacgcaccatcgagcaaatcatggatatcattggggattctataggcgctatcgcgatgattgtgtttattatcgctggcggcggcgcgtttaagcaggtattagtagatagcggtgtcgggcagtatatttcacacttaatgaccggaactacactttcgccgttattgatgtgctggactgtcgcggcgctgttgcgtatcgctctgggctctgccaccgtcgcggccattaccaccgcgggtgtggtgttgccgattatcaacgttacccatgccgatcccgctttaatggtactggcaaccggtgcgggcagcgtgatcgcgtcacacgtaaacgaccctggcttctggctatttaaagggtattttaatctgacggttggtgaaacgttgcgtacctggacggtgatggaaacccttatttctattatgggtttgctgggcgtgttagccattaacgccgtattgcactgaaagaataaaatattgtgatgtagtttcgggggaagattgaagattcccccgacgttgggagaagttatgcgcaatcacagaatttctttacaggatatcgctacgctggctggcgtaacaaaaatgaccgtgagtcgttatatccgctcgccgaaaaaggtggcaaaggaaacaggcgagcgcatcgccaaaattatggaagagatcaattatatccctaatcgcgctcccggcatgttgttgaatgcacaaagttataccctcggtatcttgattccgtcatttcaaaatcaactcttcgctgacattctcgcgggaatagaatccgtcacctctgtgcataattatcagaccattattgctaattacaattacgatcgcgattccgaagaagagtcggtgattaacctgctctcttataacattgacgggattatactttcggaaaaatatcacaccatcaggacggtgaaatttctgcgttcagccaccattccggtcgtggaattgatggatgtacagggagaacggctggatatggaggtcggttttgataatcggcaggccgcttttgacatggtgtgtaccatgctggagaagcgagtcaggcacaaaattctgtatctcggttccaaagatgacacccgcgatgaacagcgttatcaggggtattgcgatgcgatgatgctgcataatctttccccattacgcatgaatccacgcgccatctcatccattcatttaggaatgcagttaatgcgtgatgcccttagcgcaaacccggatttagacggtgtattttgcaccaatgacgatattgcgatgggtgcgcttctactgtgccgcgagcgaaaactcgccgtgccagaacaaatttccattgcgggttttcatgggctggagattggcaggcaaatgatcccaagcctcgccagcgtaattactccccgttttgatattggtcggacggctgcccaaatgttgctgagcaaaattaaaaataacgatcacaaccacaacactgttgacctcgggtatcagatttatcacggcaacacgctttaggttattttctcttcattacacgtattctctttgccggacgttgcctatactccaggcaggaaactggaggaaatctcatgagcgaacccctgttaattgcccgcacgccggacacagaactttttttactgccgggaatggctaaccgtcacggactgattactggcgcaacggggacaggtaaaaccgttacgctgcaaaaactggcagagtcattgtcggaaatcggcgtgccggtgtttatggctgatgtgaaaggcgatctgaccggtatcgcgcaggcaggaacggcgtcggaaaaactgctcgcaaggcttaaaaatatcggcgtcaatgattggcaaccgcatgccaatccggtggtggtgtgggatatctttggcgagaaaggccatccggtgcgggcgacggtttcagacctggggccgctgttgctggcgcggctgttgaatctcaacgatgtgcaatctggcgtgctgaatatcatcttccgtattgctgacgatcagggattgttgctgctcgactttaaagatttgcgggcgattacccagtacatcggcgataacgccaaatctttccagaatcagtacggaaatatcagtagcgcatcggttggtgccatccagcgcgggctgttgtcgctggaacagcaaggcgcagcacacttctttggtgagccgatgctggatatcaaagactggatgcgcaccgatgccaacggtaaaggcgttatcaatatcctcagcgccgagaaactttatcagatgccgaaactgtacgccgccagcctgctgtggatgctttcagagttgtatgaacaattgccggaagcgggcgatctggagaaaccaagactggtgtttttcttcgacgaagcacatctgctgtttaacgatgcaccgcaggtactgctggataagattgagcaggtgataagacttattcgctcaaaaggcgtgggcgtctggttcgtttcgcaaaacccgtctgatattccggataatgtgctcgggcagctcggtaatcgcgttcagcacgctttgcgggcttttacgccaaaagatcagaaagcagtgaaggcagcggcgcaaaccatgcgggccaatccggcatttgataccgaaaaggcaatccaggaactggggaccggcgaggcgttaatctcgtttctcgatgcaaaaggaagtccttctgtggtggaacgggcgatggtgattgcgccttgttcgcggatgggaccggtgacggaagatgagcgtaatggcttgattaatcactctccggtgtatggcaagtacgaggatgacgtggaccgggaatccgcctatgagatgttgcaaaaaggcgtacaggcaagcaccgagcagcaaaataatcctgccgtgaaagggaaagaggtggcggtggatgacggcattcttggtggattgaaggatattttgtttggcactaccggaccacgcggcgggaagaaagatggtgtggtgcaaacaatggccaaaagcgccgctcgccaggtgacgaatcagattgtacgcgggatgttggggagtttgctgggggggagaagaaggtaagtcaggcgagatttgtctttgcctgatgcgacgctggcgcgtcttatcatgcccaccccacagcaatatattgaattttaattatttttcaggaatgaacgaagcacactttgctaacaataataaagggagctttcgctccctttatgcgttcattcggttacgattttctcattaacagccacaggctgattaagaagaagctggcgcttggcaacagtgcgccgatgatcggcgggatgccataaaccaacgtcagcggaccgaagatctggtccagtacgtaaaagacaaaaccgaagctaataccggtgaccacacgcacgcccatcggtacgctacgcagtgggccaaagatgaacgacagcgccatcagcatcatcaccgccacagatagcggctggaagattttgctccacatgttgagctgataacgtccggcatcctgaccgctcgacttcagatacttcacatagttgtgcaaaccgctgatagagagtgcatccgggtccagcgccaccacgcccagtttgtcaggcgtgaggttggttttccaggtgccgctcaccgtctgcgaaccggtaatctgtttcggattggtcagatcagattcatcaacctgcgacagacgccagactttatgttccgggtcaaacttcgcagtagcggcatagcgtacggattgcagacgacgattctcgttaaaggcataaatgctgatgccacctaactcttcgtcacctttaacccgctcaatgtagacgaagttgttgccatctttcgcccataaaccttgctgggtagagagcaacgagccgccgtacatcgcctgcgcacggtagttacgcgccatctgctcgccctgcggcgcgacccattcaccaatcgccatcgtcagtaagaccagcggaatggcggttttcatcaccgacagcgccacctgcatacgggtgaaaccagaagcctgcatcaccaccagttcgctgcgctgcgccagcatcccaagaccaagcaacgccccaagcagagccgccatcgggaagaagatttgcacatctttcggcacgctcagcaaggtatacattcctgcgcctaacgcgtcgtaactcccctgcccggcttttttcagctgatcgacaaacttgataatgcccgacagcgacaccagcatgaacagcgtcatcatgatggtggtgaaaatagttttaccgatatagcggtcaagtacgccaaaaggttgcatcacaccgctcctttacgcgaaaaactggcgcgcaggcggcggaccggcacggtgtcccaaaggttgagaacaatcgccaaagccagataaatcaggttaacggtccacatccacagcgtcgggtccagcttacctttaccgccgttcgatttcagggaggtctggatcaggaagaaaagtagatacagcagcatggctggcagcatcgacagtacgcgtccctgacgcgggttaaccacgctcaacggtacgaccataagtgccatcataaacacggtgaataccaacgtgatacgccagttcagttctgcgcgggcacgatcggtgtcagtgttccacaatgtacgcatgtccatctggtcggtatcgttcgggtcgagcgccaccgcctggtgaccaatgatcgcctgataatcctggaaatccgtaatgcggaaatcacgtaacagtgcagtgccttcgaagcgcgttccctggttgagagtgacgacctgggagccgtcgcgcagctgggttaaatgtccggaatcggccaccaccacagaaggacgtgcattaccttttggtcgaatttgcgcgaggaacacatctttgaaatcgctgccgtcaacgctttcgatgaacagcaccgagctgccattagtcgcttgctggaattgcccttgcgccagcgccgccatgccagggttcgctttcgcttctgctaacacttcatcctgatgacgcgatgaccacggtcccgcccacatcacgttaaccgccgcgacgattgccgtgaataccgcaaggatcattgccgctttcaccagaaccgctttgctcaggccgcaggcatgcattaccgtaatttcactttcggtatacagtttgcccagcgtcatcagcagcccgaggaacaggcttaatggcaggataagctgcgccatttccggcacgcccaacccgagaagggagagcaccagattcgccggaatatcgccgtcaaccgctgcgccgaggatcctcactaacttttgacagaagaagatcaaaagcaagatgaagagtatcgccagctggcttttgagcgtctcccgcaccagatatcttatgattatcactttaaatacgcccgtaaaaactcgtcttttgcaggattttagcttgtttcatggcttaaacgtcatttattctcttgagtcgtcgaaatcgtcgctaagataattatactcaacggattcacctctcagattttgttctgacgtgccaatgccgtaataacgttaagattaacacgaagtcatcgcaacagcggacatgagttacgaaagcttgcaattctatctgtagccaccgccgttgtctttaagattcaggagcgtagtgcatggagtttagtgtaaaaagcggtagcccggagaaacagcggagtgcctgcatcgtcgtgggcgtcttcgaaccacgtcgcctttctccgattgcagaacagctcgataaaatcagcgatgggtacatcagcgccctgctacgtcggggcgaactggaaggaaaaccggggcagacactgttgctgcaccatgttccgaatgtactttccgagcgaattctccttattggttgcggcaaagaacgtgagctggatgagcgtcagtacaagcaggttattcagaaaaccattaatacgctgaatgatactggctcgatggaagcggtctgctttctgactgaactgcacgttaaaggccgtaacaactactggaaagtgcgtcaggctgtcgagacagcaaaagagacgctctacagtttcgatcagttgaaaacgaataagagcgaaccgcgtcgcccgctgcgtaagatggtgttcaacgtgccgacccgccgtgaactgaccagcggtgagcgcgcgatccagcacggtctggcgattgccgccgggataaaagcagcgaaagatctcggtaatatgccgccgaatatctgtaacgccgcttatctcgcctctcaggcgcgccagctggctgacagctacagcaagaatgtcatcacccgcgttatcggcgaacagcagatgaaagagctgggaatgcactcttatctggcggtcggtcagggttcacaaaacgaatcgctgatgtcggtgattgagtacaaaggcaacgcgtcggaagatgcacgcccaatcgtgctggtgggtaaaggtttaaccttcgactccggcggtatctcgatcaagccttcagaaggcatggatgagatgaagtacgatatgtgcggtgcggcagcggtttacggtgtgatgcggatggtcgcggagctgcaactgccgattaacgttatcggcgtgctggcaggctgcgaaaacatgcctggcggtcgtgcctatcgtccgggcgatgtgttaaccaccatgtccggtcaaaccgttgaagtgctgaataccgacgctgaaggccgcctggtactgtgcgacgtattaacttacgttgagcggtttgagccggaagcggtgattgacgtggcgacgctgaccggtgcctgcgttatcgcgctaggccatcacattaccggtctgatggcgaaccacaatccgctggcccatgaactgattgccgcatctgaacaatccggtgaccgcgcatggcgtttgccgctgggtgacgagtatcaggaacagctggagtccaattttgccgatatggcgaacattggcggtcgtcctggtggggcgattaccgcaggttgcttcctgtcgcgctttacccgtaagtataactgggcgcacctggatatcgccggtactgcctggcgttctggtaaggcgaaaggcgcaaccggtcgcccggtggcgttgctggcacagttcctgctaaaccgcgccgggtttaacggcgaagagtaattgcatcaggctgtgttgttattgtcggatgcggcgtgaacgccttatccgacctacacagcactgaactcgtaggcctgatgagacgcgacagcgtcgcatcaggcaaggctgttattgtcggatgcggcgtgaacgccttatccgacctacacacagcacttaacttgtaggcctgataagacgcggcagcgtcgcatcaggcgctgcggtgtatacctgatgcgtatttaaatccaccacaagaagccccatatatgaaaaacgcaacgttctaccttctggacaatgacaccaccgtcgatggcttaagcgccgttgagcagttggtgtgtgaaattgccgcagaacgttggcgcagtggtaagcgcgtactcatcgcctgtgaagatgaaaagcaggcttaccgactggatgaagccctgtgggcgcgtccggcagaaagctttgttccgcataatttagcgggagaaggaccgcgcggcggtgcgccggtggagatcgcctggccgcaaaagcgcagcagcagcccgcgcgatatattgattagtctgcgaacaagctttgcagattttgccaccgctttcacagaagtggtagacttcgttccttatgaagattctctgaaacaactggcgcgcgaacgctataaagcctaccgcgtggctggtttcaacctgaatacggcaacctggaaataatggaaaagacatataacccacaagatatcgaacagccgctttacgagcactgggaaaagcagggctactttaagcctaatggcgatgaaagccaggaaagtttctgcatcatgatcccgccgccgaacgtcaccggcagtttgcatatgggtcacgccttccagcaaaccatcatggataccatgatccgctatcagcgcatgcagggcaaaaacaccctgtggcaggtcggtactgaccacgccgggatcgctacccagatggtcgttgagcgcaagattgccgcagaagaaggtaaaacccgtcacgactacggccgcgaagctttcatcgacaaaatctgggaatggaaagcggaatccggcggcaccattacccgtcagatgcgccgtctcggcaactccgtcgactgggagcgtgaacgcttcaccatggacgaaggcctgtccaatgcggtgaaagaagttttcgttcgtctgtataaagaagacctgatttaccgtggcaaacgcctggtaaactgggacccgaaactgcgcaccgctatctccgacctggaagtggaaaaccgcgaatcgaaaggttcgatgtggcacatccgctatccgctggctgacggcgcgaaaaccgcagacggtaaagattatctggtggttgcgactacccgtccggaaactctgctgggcgatactggcgtggccgttaacccggaagatccgcgttataaagatctgattggcaaatatgtcattctgccactggttaaccgtcgtattccgatcgttggcgacgaacacgccgacatggaaaaaggcactggctgcgtgaagatcaccccagcgcacgactttaacgactatgaagtcggtaaacgtcacgccctgccgatgatcaacatcctgacctttgacggcgatatccgtgaaagcgcccaggtgttcgataccaaaggtaacgaatctgacgtttattccagcgaaatcccggcagagttccagaaactggagcgttttgctgcacgtaaagccgtcgttgctgcggttgacgcgctcggcctgctggaagaaattaaaccgcacgacctgaccgttccttacggcgaccgtggcggcgtggttatcgaaccgatgctgaccgaccagtggtacgttcgtgccgatgtactggcgaaaccagcggttgaagcggttgagaacggcgacattcagttcgtaccgaagcagtacgaaaacatgtatttctcctggatgcgcgatattcaggactggtgtatctctcgtcagctatggtggggtcaccgtatcccggcatggtatgacgaagcgggtaatgtttatgttggccgcaacgaagacgaagtgcgtaaagaaaataacctcggtgctgatgttgcgctgcgtcaggatgaagacgttctcgacacctggttctcctccgcgctgtggaccttctccacgctcggctggccggaaaacaccgacgcactgcgccagttccacccaaccagcgtgatggtatccggcttcgacatcatcttcttctggattgcccgcatgatcatgatgaccatgcacttcatcaaagatgaaaatggcaaaccgcaggtgccgttccacaccgtttacatgaccggcctgattcgtgatgacgaaggccagaagatgtccaaatccaaaggtaacgtgattgacccactggatatggttgacggtatttcgctgccggaactgctggaaaaacgtaccggcaatatgatgcagccgcagctggcggacaaaatccgtaagcgcaccgagaagcagttcccgaacggcattgagccgcacggtactgacgcgctgcgcttcaccctggcggcgctggcttctaccggtcgtgacatcaactgggatatgaagcgtctggaaggctaccgtaacttctgtaacaagctgtggaacgccagccgttttgtgctgatgaacacggaaggtcaggattgcggcttcaacggcggtgaaatgacgctgtcgctggcggatcgctggattctggcggagttcaaccagaccatcaaagcgtaccgcgaagcgctggacagcttccgcttcgatatcgccgcaggcattctgtatgaattcacctggaaccagttctgtgactggtatctggagctgaccaagccggtaatgaacggtggaacagaagccgaactgcgcggtactcgccatacgctggtgactgtactggaaggtctgctgcgcctcgcgcatccgatcattccgttcatcaccgaaaccatctggcagcgtgtgaaagtactttgcggtatcactgccgacaccatcatgctgcagccgttcccgcagtacgatgcgtctcaggttgatgaagccgcactggccgacaccgagtggctgaaacaggcgatcgttgctgtacgtaacatccgtgcagaaatgaacatcgcaccgggtaaaccgctggagctgctgctgcgtggttgcagcgcggatgcagaacgtcgcgtaaatgaaaaccgcggcttcctgcaaacgctggcgcgtctggaaagcatcaccgtgctgcctgctgatgataaaggtccggtttccgttacaaagatcgtcgacggcgcagaactgctgatcccgatggcaggcctcatcaacaaagaagatgagctggcacgtctggcgaaagaagtggcgaagattgaaggtgaaattagccgcatcgagaacaaactggcgaacgaaggctttgtagcgcgcgcaccggaagcggtcatcgcgaaagagcgtgagaagctggaaggttatgcggaagcgaaagcgaaactgattgagcagcaggctgttatcgccgcgctgtaatactcatagtgaaaacgaaggccggagcgtgctccggcctttttatttagataaacggaacatacggcataataccgcgagatatccacattaacgaaccgctatcctgcggtttgtcatcattggttaactccagcgaatcaaggtcgccctggacatgggtattgttagcaatccagctaaccatccacattttcagccagggataagccagaccacaggtaattgaggaccccattaataccgccaacatgcgcagaagcataccgatcgcggtaacagatgaatgaaaacgaattgtcccatttgccagcgtcagattattcaaaaacagattgcgtaacgtgacatagagataactggcaaaaacaaggatcgcgacaaaatacaggaaataagaagccataatctgcgggtaatattgtaatacaaactcactgccagcatcagacctacccaacatggtcatcatcattaactgctggaatactggtgcgatcataataccaatcacaatgatgaaaggaaccatggttaatattgcgagcatgcaacctttaatgcattcttttacgtttacctgaatagaaaacttatgaatgccaaaagttgcattattacccagcaatggcatccatttactataggttataccatggacaacacctagcccgatggcagaaagcaaacttaatgcgactaagttaaagaataagcctcctatcgatgtcgtcacttgcgcaataagatacagtgcgaaccaaaaaactaacgccaacagaacaggcagtcctagcataacccaccatgcacgcatcattgagcagttaaagccaaagcgaatgtcattcagtgaggtcatgttcgcctgatactgcagactcttcactgccatacaaggaataccgcagatcaagagagcaaacaggaataaaccgagcgcaaagtgttgacctgcaaaacaagaaatactgagaagataaaccaccacaataagtaacatgctaacaaaaatggcaccacctgttcccttataactaaatggttgccccttgagtgtcacatgttgataaatataacgacggcattttatcaatgcccacggtccatatattcccagagtaataattgtcagtaaaaaactcacaagacaaataagaaaatactcaccacctttgcctgtgaaaacaaacgagtgccgagaattatctttcccgatgtttacatcattcatgaactatatccctaaaataaattccattcataccgataataattccagtcaattgatactggttcgcctagaatacgctttatctcagagagatatgcgtaatattttctgatttatcttcttcttgcaccacctaagcgagggtggtattaaagtgagctataaatcatacatttgaaattgagctatgctatgaatgttgtcgcttctcccgcactccgtttgcgcaaacttaccgtcgccgataatcctgctatcgcccacgtcattcgtcaggtatccgccgaatacggtcttaccgctgataaaggctacaccgtcgccgatccgaaccttgacgagctgtatcaagtgtatagtcagcctggccacgcatattgggtggttgagtacgagggtgaagtggtcggcggcggtgggattgcgccattaaccgggagtgagtcagacatttgcgaactgcaaaagatgtattttcttccggctatccgcggcaaagggctggcaaaaaaactggccttaatggcaatggagcaggcgcgagaaatgggtttcaaacgctgctatctggaaacgaccgcttttttaaaggaagccattgcgctttatgagcatttgggctttgagcatatcgactatgcgcttggctgcacgggtcatgtcgattgtgaagtacggatgctacgcaaactttgaaaaatgcccgcgagcttagactcgcgggcattcgaacattaaccacgtgctttttgagtatgctggatgtgacgtaaatgccttatccgggctacaaattcaccaggttgcaggaactacctgggcctgatatgcgtagcgcatcaggtaacgcagcctttgtcgtcaacgcttaattagtgacgaataccgtcatcgtcttcatcgacaaaatcttcatcgtcgccgtcttcgccgttaggatcttcaaagtaagtgccccacccatcgtactcaacgtcaaatttctccgccagcgtcatcagttgttcaacctgggcatcgatcaggtcggcattcaacgcacactcgctgaggatgtcgcagcaaatcacgatgtcaccatcttcaacttccagctcttctggatcggtcacttcgtaaccgagtttaaacgcttcaactgctgctttttccagggtttccagatcgtctgcggaaagatggtgttcgatggtgtacagcgcgtccggatcgctgccatcttccagtaattcttcaataatcaaacgtgtttcttcacgctgttcttccagttgttccgggtttgccatggcttattcctcttaatgtcctgccgatactcttattgtcacacaccactgacattgcctccacctttgtgacaaagatttatgctttagacttgcaaatgaataatcatacatataaattgaattttaattcattaaggcgttagccacaggagggatctatgtccgggttttatcataagcatttcctgaaattactcgatttcacgccagctgaactcaacagcttgttgcagttagccgcgaagctgaaagccgataagaaaagcggtaaagaagaagccagactcactggcaaaaacatcgcgctcatcttcgaaaaagactcgacccgtacccgatgctctttcgaagttgccgcatatgaccagggtgctcgcgttacttatctcggcccaagcggcagccagattggtcacaaagagtcgattaaagacactgcccgcgtgcttggtcgcatgtatgacggtattcagtatcgcggctatggtcaggagattgtcgaaacactggcggaatacgctggcgtgccagtatggaacggcctgaccaatgagttccaccccacgcagctgctggcggatctcctcaccatgcaggagcatttgcccggcaaagcattcaacgaaatgacgctggtctatgcaggtgacgcgcgtaacaacatgggcaattcgatgctcgaagctgcggcgcttaccggtctggacttgcgtctggtcgcaccacaggcatgctggccggaagctgcgctggtcgccgaatgcagtgctctggcacaaaaacacgggggtaaaatcaccttgacggaagatatcgcctctggggttaaaggcgcagactttatctataccgatgtctgggtatcgatgggtgagcccaaagagaaatgggcggagcgtattgccctgctgcgtgactatcaggtgaatagcaaaatgatggccctgaccggtaattcgcaggttaagttcctccactgtctgcctgcatttcatgatgagcaaaccacgctgggtaaaaaaatggccgcagaattcggtctgtatggtggaatggaagtcaccgatgaagtctttgaatctccagcaagtattgtctttgaccaggcagaaaaccggatgcacaccataaaagctgttatggtcgctacattagcaaaataacgttttgccgggcggcggcacagggcgcccccggcagtgatcacttacgcttttaatagcttaactactgctttccgtacctgagcgggggctcccaccgcacaaagcggtttgtgaacttcgccaggatagaaaacgacaaaatccccttcattaagaatcactgttttttcatcgatcccctgcccgataaaagcaatatctttatctgccagccagtcagtctctggtacgcctgctggttgcgtgctaaatgtcatcccttcctgcccttttaatacaatctggatatcgagataacgagcatgatactcagcacgacgcagttcacctggttcagtcgtatcctcagaaatcagataaaacaggcggtcgccgtcaatagcgtgcttaccttttgctgtctcatcgctgacatgtgatttgatgtactcaattgcttcgcgaagttcttccggcagccaggattgtaagtgatggatgttgccaacaatcataatatcttcctttattaaaacaatgtttcacttctttccttatacgaaaaaaagccacctctcaccatagaaaaatcatcaggttttgcccttgcgcatgtttattgctggagatgttgtactgatgttaagcaggagtaattttgtatgcagttttgctgcataaatcttataacttagctatgtattttggtcctaatatcttgttattgcatatgttaaaagaaaactctcagtcagatcacagttcattttcttagcttttaatgcccgtgctgtcatagttatcccgtgaaaatagtgctgtgaaaaataatcaccttatcctttcgcatagatatgcaatgaatattaaaatatacataaatatcaatgcattatacttaaaggcatttcctgaaaaataaaacaatcaattaacaacgaagaataactctgcgtatatttgcgtattaatgcattatcgtattttgtttctttatcatttatcagaaccgcatcaaatattatcaacttcgattattaatatcaccgccggtgtgaaagccgtcacattttctggaagaaataaactgaatcattgcatctgaaaattactgaacagacctgactacaagcatttcatttgtttgcagccatctcctctttatttttgaaaaagtgttaaaggaataatgatggaaaagcattatgttggttctgaaattggacaactatgcagcgttatgttgcatcgcccaaatctcagtctgaaacgtctaacaccatccaattgccaggagttgttatttgacgatgtattgtccgttgagcgggcaggtgaagagcatgatattttcgccaatacgctgcgccagcaagggatagaagttctgttactcactgatttactaacacaaacattggatatcccggaagccaaaagctggttactggaaacacaaatatcagattaccgactcggccctacgtttgctactgacgtccgcacctggcttgcagagatgtcacaccgggaccttgctcgtcatttaagtggtgggctgacttatagtgaaattcccgcctcaattaaaaatatggtggttgatacccacgatattaatgatttcattatgaagccgttaccgaatcatttatttacgcgtgatacctcatgctggatttataacggtgtatcgattaatccaatggcaaaacctgctcgccaacgtgaaaccaataatctacgcgctatttatcgctggcatccacaatttgctggcggcgaatttattaaatatttcggcgacgagaatattaattatgaccacgccacgttagaaggtggtgatgtgctggtgattggtcggggggccgtgttgatcggcatgtctgaacgcaccacgccacaaggagtcgagtttcttgctcaggcattgtttaaacatcgtcaggctgaacgggtaatcgctgttgagctgcctaaacaccgctactgtatgcatcttgacaccgttatgactcatatcgatatcgacaccttctcggtttatcccgaagttgtgcgcccggatgttaattgctggacgctaacacctgacggtcacggcggcctgaaacgtactcaagaaagcacactcctccatgctatcgaaaaagccctcggtattgaccaggtacgtttaatcaccacggggggtgatgcctttgaggcagaacgcgaacagtggaatgacgctaacaatgtgctcacgcttcggccgggagtggtagtgggctacgagcgcaacatctggactaacgaaaaatatgacaaagcaggcatcaccgttttacccatccccggtgatgaattaggccgcggacgtggcggcgcacgttgcatgagttgccctttgcatcgtgacggtatctaaggaagagatcatggaaaacaaaccaacactggttatcgctctcggcggtaatgccctgcttaaacgaggcgaaccactcgaagcagaaatccaacgtaaaaatatcgatcttgcggctaaaactatcgcccaactgactcaacactggcgggttgtactggttcacgggaatggtccacaagttggacttctggcacttcaaaatagcgcctatgcccatgtcgctccctatccactcgacattctgggggccgaaagccaggggatgatcggctacatgctacaacaggcgctgaaaaatcaactaccacaacgtgaaatcagcgtgctgctgacgcaggttgaagtggatgccaacgatcccgccttcagtaacccaactaagtacatcggcccaatttatgaccacgctcagactcaggtactacaggcagaaaaaggctgggttttcaaagcagatggtcactctttccgccgggtcgtaccttctccacaacctaaacgcatcgtcgagcgggatgccatccagacactgatcgcccacgatcatctggtgatctgtaatggtggcggtggtgttccggtggttgaaaaagccgatggataccatgggattgaagcggttatcgacaaagatctttcagccgcgctactggcaagtcagatccatgctgacgccttgttgatcctcactgatgcggacgcagtatatctcgactggggcaagccaacccaacgcccgctggcccaggtcacgccggaattactcaacgaaatgcagtttgatgccgggtctatggggccgaaagtcaccgcctgcgcaaagtttgttagtcagtgccggggcattgcagggatcggctctcttgcagatggtccggaaattctcgccggagacaaaggcactcttattcgccttgatacccccataaccacgcttgatccatttttataaggacatccccatggctacttcactgaaaaaccgtaattttcttaagctgcttgattacaccccagcagagattcaatacctgattgatttggctatcaatcttaaagccgccaagaaatctggaaacgaaaaacaaacgctggtcggtaaaaacattgcgttgatttttgaaaaatcctctacccgtacccgctgtgcctttgaagtcgcggcctttgatcaaggtgcgcaggtgacttacatcggccccagcggctcacaaatcggccataaagaatcaatgaaagataccgctcgcgtactcggacgcatgtatgacggtattgagtatcgcggttatggtcagaatatcgttgaagaattaggtgagttcgctggtgttccggtatggaacggactgaccaatgaatttcacccgacacagatcctcgcggatttaatgaccatgctggaacatgcgccaggcaaaacgctgccagagctgagctttgcgtatcttggtgatgcccgaaataacatggggaactcgctgatggttggtgctgcaaaaatggggatggatatccgtctggtggcacctaaatctttctggccagatgaagcgctggtaacacaatgccgtgagatcgccagcgtgactggggcgagaatcaccctgacagaggatgtggaagaaggcgtatacgacgttgattttctctatacggatgtttgggtttcgatgggagagccaaaagaagcctgggcagaacgagtgagtctgatggcaccttatcagatcaatcaacaggtgattactgccacgcgtaaccctgaagttaaatttatgcactgcctgcccgccttccataatgagcacaccacagtaggacgcgagatcgagatggcctacggcctcaaaggactggaagttactgaagaggtttttgaatcggcccactctattgttttcgatgaagcagaaaaccggatgcacaccattaaagcggtgatggtagcaactctcggcgactaaccctgacgggcatgcgtcgacgagtggcgtatgcccgtgattatggagatcacattatgggtaaattcaaatttcccaccgcttataccatcttgttcgtgctgattgcgttagttgcggcaatgacctggattgtacctgcgggaaaatatcagatggtgacaaatgccgcactgggaaaggaagttcctgttgcaggcacttacgcacctgttgaggcacaaccacagggtattacggctgtcctgttagcgcccatcgacggcttgtacaaccatcaaacctacactgcgggagcgattgatgtcgcgctgtttgtcctgatcatcggtggatttttgggagtagtaaataaaaccggggcaatagatgccggtatcgaacgagtgacaactcgccttaatggtcgggaagagtggatgattccgatcctgatggcgctcttcgctgctggcggtactatttatgggatggcggaagaatcactccccttctacacgttgctggtgcccgtcatgatggctgcccgctttgatcctctggtcgctgccgccacagtgttattgggatcgggcattggcacgctgggctcaaccattaacccatttgctaccgtcattgctgccaacgccgcagggatcccctttactcagggcattttgctgcgtgttattttgctgttagtaggctacgtgatttgtgtttactgggttatgcgttatgcccgcaaagttcgcaacagtccggaaagctctatcgtggcggataagatggctgaaaaccaggcgcattttctgggaaatcgttcagaaacgatgctggaatttacccccacgcgcaaagcgatcctgatactttttgctgcatcctttgcctttatgatttacggcgtagcggtactgggttggtggatggcggaaatctctgctgtctttctggcagctgcggtcatcgtgggtgtcattgcccgcatgggcgaagaaaccttcaccagtacctttattgacggcgcgcgggatctccttggtgtggcactgattatcggcatcgcccgcggtattgtggtcgtgatggataacggcatgattacgcacacaattctgcacagtgctgagaatctggtttcagggctttccaccactgttttcatcaacgtgacctattggctggaagtattgctctcttttctggttccctcatcttccggccttgcagtgttaacgatgccaataatggctccactcgctgattttgctcatgtacaacgcgatctggtggtgaccgcttatcagtctgcttccggggtggttaatttgattacgccaacctctgcggtagtgatgggcggtctggcgattgcccgtgtaccctgggtccgttatctgagatgggtagcaccgctactgctgattctcacgatgttgaatatgattgtgctgagtatcgccgcgatgatttaacgcgacaggccgcttatcaaagcggccttcaaatctggtgtagtgataaatgaaccactctcacattataaaatgtgaaaaatatcatcaggtaataataaataaaaggtgcattatgaaggaatacgatgattactccgccaaagaaaagaagcaactggcggtctgtcagcgcctgattaccgaaaaaagttatctttcacaggaggaaatccgccgcgatttgcaaaaccatggctttgacagtatcagtcagtcaaccgtttcacgactactgaaattgctgggagtcataaaaattagaaatacaaaaggacaaaaaatttattcggtgaatcctcaattacttcccacacctgacgcaggtcgatccgtcgctgaaatggtcctgagtgtcgagcataatggtgaatttatccttatccataccgtcgccggatatggtcgggcagtagcgcgaatccttgatttccatgctttgccagaaattcttggcgtgattgctggcagcaatatcgtttgggtcgcaccacgtgtggtaaagcgtacagccctggtgcacaagcaaattaattacttattaaaattgaatatatattcatgataaccgtttgccttgctttataactgcatcatcttcttgatcctctctcagagctgagtataatgccggacaatttgccgggaggatgtatggttcagtgtgttcgacattttgtcttaccgcgtctgaaaaaagacgctggcctgccgtttttcttcccgttgatcacccattcccagcccctcaatcgaggggcttttttttgcccaggcgtcaggagataaaagatggctaatccgctatatcagaaacatatcatttccataaacgaccttagtcgcgatgaccttaatctggtgctggcgacagcggcgaaactgaaagcgaacccgcaaccagagctgttgaagcacaaagttattgccagctgtttcttcgaagcctctacccgcacccgcctctctttcgaaacttccatgcaccgcctgggtgccagcgtggtgggcttctccgacagcgccaatacatcactgggtaaaaagggcgaaacgctggccgataccatttcggttatcagcacttacgtcgatgcgatagtgatgcgtcatccgcaggaaggtgcagcgcgcctggccaccgagttttccggcaatgtaccggtactgaatgccggtgatggctccaaccaacatccgacgcaaaccttgctggacttattcaccattcaggaaacccaggggcgtctggacaatctccacgtcgcaatggttggtgacctgaaatatggccgcaccgttcactccctgacccaggcgctagcgaagttcgacggcaaccgtttttactttatcgcgccggatgcgctggcaatgccgcaatacattctggatatgctcgatgaaaaagggatcgcctggagtctgcacagctctattgaagaagtgatggcggaagtagacatcctgtacatgacccgcgtgcaaaaagagcgtctggacccgtccgagtacgccaacgtgaaagcgcagtttgttcttcgcgccagcgatctccacaacgccaaagccaatatgaaagtgctgcatccgctgccgcgtgttgatgagattgcgacggatgtggataaaacgcctcacgcctggtacttccagcaagcaggcaacgggattttcgctcgccaggcgttactggcactggttctgaatcgcgatctggtactgtaaggggaaatagagatgacacacgataataaattgcaggttgaagctattaaacgcggcacggtaattgaccatatccccgcccagatcggttttaagctgttgagtctgttcaagttgaccgaaacagatcagcgcatcaccattggtctgaatttgccttctggcgagatgggccgcaaagatttgatcaaaatcgaaaatacctttttaagtgaggatcaggttgatcagctggcgttatatgcaccgcaagccacggttaaccgtatcgacaactatgaagtggttggcaaatcgcgccccagtttgccagagcgcatcgacaatgtgctggtctgccctaacagcaactgtatcagccatgccgaaccggtttcatccagctttgccgtgcgaaaacgcgccaatgatatcgcgctcaaatgcaaatactgtgaaaaagagttttctcataatgtggtgctggccaattaattgcggttggtaataaaagtctggctccctataatgagccagactttttaccgctgtaataaaggagaaatcatgagcaaaactatcgcgacggaaaatgcaccggcagctatcggtccttacgtacagggcgttgatctgggcaatatgatcatcacctccggtcagatcccggtaaatccgaaaacgggcgaagtcccggcagacgtcgctgcacaggcgcgtcagtcgctggataacgtaaaagcgatcgtcgaagccgctggcctgaaagtgggcgacatcgttaaaactaccgtgtttgtgaaagatctgaacgacttcgcaaccgttaatgctacctacgaagccttcttcaccgaacacaacgccaccttcccggcacgttcttgcgttgaagtagcccgtctgccgaaagacgtgaagattgagatcgaagcgatcgctgttcgtcgctaatcttgatggaaatccgggctatcatgcccggattaagtctgatgacaaaagcaaaatcgcctgatgcgctacgcttatcaggcctacgtgattcctgcaatttattgaatttgtagaccggattaggcggttacgccgcatccggcatgaacaaagctcactttgtctgcaatctgattccgggccaccatgcccagtttattctttactgccaaccgtaacgacggctatagaaacctttcaccaactgggttaacgtcatataccctgccagaatcgcaaccagccacgggaaatagcttaacggcagcgcctgcagttgcagataactggccagcggtgaaaacggcaatgcgatcccgacaatcatcacgatcacggtcatgatcattaacggccacgatgcacagctctgaataaacggcacacggcgggtgcggatcatatgcacaatcagcgtttgcgacagtaagcccaccacaaaccagcccgactggaacagcgtttgcgtttccggcgtgttggcatggaatacccaccacatcaggcaaaacgtcagaatatcgaaaatcgagctgatcggtccgaagaagaccataaagcgccccagatccgccggattccaacgctgcggcttttgaatttgctcgtcgtcgacgttatcaaatgggatcgccacctgtgacacatcgtacagcagattttgaataagcaagtgtagcggcaacatcggcaggaagggcaagaaagcactcgccaccagcacgctgaacacattaccgaagttagagctcgccgtcattttgatgtatttcagcatgttggcgaaagtgcgacgaccctcaataaccccctcttccagcaccatcaggcttttttccagtaggatgatatcagccgcttcacgggcaatatctaccgcgccgtccacagaaatgccgatatccgcagcgcgtaaggcgggcgcatcattaataccatcgcccataaagccaaccacatgcccttcgcgcttcagcaacgttacgatgcgttctttatgcatcggcgtcagacgagcaaacagcgtggtgcgctgtgcgagatttgccagttcgtcgtcagatagcgtttcaatatcactaccaatgaccacctctcccgcgtccagccccacttcatggcacactttcgctgcaactaactcactgtcgccagtaaggatttttacggtaattccactcgcttttaatgccttcagtgccggagcggttgtctcttttggcggatcaaggaaagcaatatatccttcgaggatcaggtcggattcatccgcccgctggtaatctccttcacgcgctggcaggtatttcgtcgccaccgcaaccacgcgcagcccctgacgattcagcgtatcagtaacccgcttaatcttacgcagcatggtgtcatcgagcggtacaatctcgccattgtgacgcacttgcgaacacacattgaggatttcctgcaatgcgcctttgcaaaccaactgatggtgttcggtattttctgccacaaccaccgacatccgacgacgctcgaaatcaaatggaatctcatcaattttttgccaacggctggccagcgagcgcgctgactcttcatccgtaccttcgagcaccgcggtatcaagcaggtttttaagcccggtctggtaatggctgttcaaccacgcgctatgcagcacgcgttcgctagttttaccggagatatcggtatgattctccagcacaattttatcctgtgtcagggtgccggttttatcagtgcacagaatatccattgcgccaaagttctgaatggcatccaaatgtttgacgatcactttctgtttcgacaacttgactgcgccacgcgccagcgtcgaggtaacaatcatcggcaacatttctggcgttaagcctaccgcgaccgaaagcgcaaacagtgcagcttcccaccagtcgcctttagtgtaaccattgataagcaacaccaccggagccatcaccagcataaagcgaatcagcagcatactgacgcggctaatcccttgctgaaaggcattcggctcgctttcctgctcactaacacgacccgccagttgaccaaaccaggtattggcacctgtggcaatcaccattgcttgtgccgtgccgctcaccacggtggtgcccataaaacacagggtgtcgcactccagcggattgctgtgctccggctggcgagtggtagcggctttttctacgggcagagactcaccggttaacgacgcctgagcgacaaacagatcccgcgcctgcaagatacgtaaatctgccgggatcatatcccccgccgccagttttataatatcgccgggcaccagttggtctatcgggatttccagccagccattttcacctttatcgttaattacgcgcagtaccgtcgcggtattactgaccatcgctttcagggcatctgccgctttggtggaacgagcttcctgaataaagttcagcaacgtagaaatagcgaccattagcgcgataacacctgcggcaaataaatcttccgtggcgtaagaaatagcaccgagaatggtaagcaaaatattaaaggggttgcgatagcagacccataaatgtacccaccacggcgacggttgttgtgcgggtaatttattttcaccatgttgttcgcgggcagattccacttccgccagatttaacccttccggatgggtgtcgaacgttttccacaattcttcttcgggcatcaccgccattttcaggcaatgcgcacttaaagaaggcgggaccgccgcattcactgtctgctgcgcgccaggcaatggatcacgatgaaccagacgggaaggtaaatggcgaatgaaccgggtaaaaatttctttaaacataaggagtccctccgcactgtctgaaacagtacagaaatgtcttcaggcgtggcgaagccttacctgaaggtaataaagctgagcagggacgttaaaacgtcacggccttacgcatccggtaacgccgtgaaaagacgggcttaccggaaaagttttaatctccgtcgagggagaggcgtgggatcaggttccatataacctccggtaagtgaaaaaagcgccgcaaataataaggagaatccaataatattcgtagcatttatggcgatataatacctgctggcaactaaaccaacgataaaccagactttacccattgctgaatgcacaggtaaagttaggctcaaataattaaacaacacgttatgggacaacaggatgcaaaatcggctgaccatcaaagacatcgcgcgcttaagcggcgtggggaaatctacagtttcccgggtgctgaataacgaaagcggcgtgagccagcgcacgcgcgagcgtgttgaagcagtgatgaatcagcatggattttccccttcccgctccgcgcgcgctatgcgtgggcaaagcgataaagtggtcgccatcattgttacccgtctggattcgttgtcagaaaatctcgccgttcaaaccatgctgccagcgttctatgaacaaggttacgatccaatcatgatggaaagtcagttttccccacaattagttgccgaacatttgggggtgctgaaacggcgtaatatcgacggcgtagtgctgttcggttttaccggcataacagaagaaatgttagcccactggcagtcatcgctggttctgctggcgcgtgacgcaaaaggctttgcttcggtctgttatgacgacgaaggggcaatcaagatcctgatgcaacggctgtatgaccagggacatcgtaatatcagctatctcggcgtgccgcatagtgacgtgacgaccggtaagcgacgtcacgaagcctacctggcgttctgcaaaacgcataaattgcatcccgttgccgctctgccagggcttgctatgaagcaaggctatgagaacgtagcaaaagtgattacgcctgaaactaccgcgttactgtgcgcaaccgacacgctggcacttggcgcaagtaaatacctgcaagagcaacgcatcgacaccttgcaactggcgagcgtcggtaatacaccgttaatgaaattcctccatccagagatcgtcaccgtagatcccggttatgccgaagctggacgccaggcggcctgccagttgatcgcgcaggtaaccgggcgcagcgaaccgcaacaaatcatcatccccgccaccctgtcctgatcgtttcctgaacgataaattgtgatcttcgctgcgtttcgggaacgttcccgtttttaaatttttccgcgcaatatattctgcagccaaccaaaaatgtcatctgccatggggctttatgatgagcaaaataaaccaaacggatatcgatcggttgattgaactggtcggcgggcgcggcaatattgcgacggtgagccactgtattactcgcctgcgctttgtcctcaaccaaccggccaatgccagaccgaaagaaattgagcaactccccatggtgaaaggctgtttcaccaatgccgggcaatttcaggtggtgattggcaccaacgtgggtgattactatcaagcactgattgcgtcaaccggacaggcgcaggttgataaagagcaggtaaaaaaagccgcccggcagaatatgaaatgtcatgagcagttgatctctcatttcgcggagatcttcttcccgttgctgcccgcgttgattagtggtggtttgatcctcggttttcgcaatgtgatcggcgatttgcccatgagcaacggtcagacgctggcgcaaatgtacccttccctgcaaacgatctacgattttctgtggttgatcggtgaagcgatcttcttctacctgccggtcgggatttgctggtcagcggtgaaaaaaatgggcggtacaccgatcctcggtatcgtgcttggcgtaacgctggtttctccacagctgatgaacgcttatctgctcgggcagcagctgccggaagtatgggactttggcatgttcagcatcgccaaagtgggctatcaggcgcaggtcatcccggcactgttagccggactggcgctgggcgttattgaaactcgtcttaagcgcatcgtgccggattacctctatctggtggtggtgcccgtctgttcgctgatcctcgcggtgttcctcgcccatgcgctgattggtccgtttggtcgcatgattggcgatggcgttgcctttgcggtacgtcacctgatgaccggcagctttgctccgattggcgcggcattgtttggcttcctgtacgccccgctggtgatcaccggcgtacaccagaccacgcttgctattgatttgcagatgattcaaagcatgggtggcacgccagtgtggccgctgattgcactgtcgaatatcgctcagggctccgccgtgataggtattatcatttccagccgcaagcacaatgaacgcgagatctccgtgcctgccgctatctccgcctggcttggagtcactgaacctgctatgtacggcatcaacctgaaatatcgtttcccgatgctgtgcgcgatgattggttctggtctggcaggattgctatgcggcctgaacggcgttatggcgaatggcatcggcgtaggcggcctgccgggcatcctctccattcagccgagctactggcaggtgtttgcgctggcaatggctatcgccatcatcatcccgattgtactcacctcgtttatctatcagcggaaataccgcctgggcacgctggacattgtttaattttcttcggggcgcaattgcgccccctcgcatttgcaggaataacgtaatgactcatcttccccactggtggcaaaacggcgttatctaccagatttatccaaagagttttcaggacaccacgggtagcggcaccggcgatttacgtggcgttatccaacgcctggactatctgtataaactgggcgttgatgccatctggctaacccccttttatgtctctccccaggtcgataacggttacgacgtagcgaattatacggcgattgatcccacctatggcacgctggacgattttgacgaactggtgacacaggcaaaatcgcgtgggattcgtatcattctcgatatggtgtttaaccatacctctacccaacatgcctggtttcgcgaggcgctgaacaaagaaagcccttaccgccagttttatatctggcgcgatggagaaccagaaacgccaccgaacaactggcgttcaaaattcggtggtagtgcgtggcgctggcatgcagaaagcgaacagtactatttgcatctctttgcaccagaacaggcggatctcaactgggagaatccagcggtacgcgcagagctgaaaaaagtctgtgagttctgggccgatcgtggggtcgacgggttgcgcctggatgtggtgaatctgatctccaaagatccgcgttaccctgaagacctggatggcgacgggcgtcgcttctacaccgacgggccacgagcacacgagtttttgcacgagatgaaccgcgatgtgtttacgccacgcgggttaatgaccgtaggtgaaatgtcctccaccagccttgagcattgccagcgatacgcggcactgacaggcagtgaattgtcgatgacctttaattttcatcacctgaaggtcgattatcccggtggtgaaaaatggacgctggctaaacctgactttgtggcgttgaaaacattgttctgccactggcaacaaggaatgcacaacgtggcatggaatgccttgttctggtgtaaccacgatcagccgcgcattgtttctcgctttggtgatgaaggtgaataccgcgtgcctgcggcaaaaatgctggcgatggtgctgcatggcatgcagggaacgccgtatatctaccagggcgaagagattggcatgaccaacccacatttcacgcgcattactgactatcgcgacgtggagagcctcaatatgtttgccgagctgcgcaacgatgggcgtgatgccgacgagttattgacaatcctcgccagtaaatcccgtgacaacagtcgcacacccatgcaatggaccaacggcgataatgccgggtttacggctggcgaaccgtggattggcctgggcgataactatcaggaaatcaacgtagaagcagcgctggccgatgagtcctcggtgttttacacctaccaaaagttaatcgcactgcgtaagcaagaagccgtcctgacatggggcgattaccaggatctgctgccaaacagccctgtattgtggtgctatcgccgtgagtggaaggggcaaaccttgctggtcattgccaaccttagccgtgagacccaaccctggcagccagggaaaatgctcggcaactggcagcttgtgatgcataactacgaagaagcctcaccacaaccctgtaccatgactttacggccttttgaggctgtctggtggttacagaagtaaatcttcgctaagccccggtaatgcctgtcattccggggttttgcctgtcagtatgttgtttttgttgattttataatcaaaaaattcattaaaaaatttacatatcgctgtagcgcccgtcatccgtacgctctgctttttactttgagctacatcaaaaaaagttcaaacatccttgatgcaaagcactatatatagactttaaaatgcgtcccaacccaatatgttgtattaatcaactataattgctactacagctccccacgaaaaaggtgcggcgttgtggataagcggatggcgattgcggaaagcaccggaaaacgaaacgaaaaaaccggaaaacgcctttcccaatttctgtggataacctgttcttaaaaatatggagcgatcatgacaccgcatgtgatgaaacgagacggctgcaaagtgccgtttaaatcagagcgcatcaaagaagcgattctgcgtgcagctaaagcagcggaagtcgatgatgccgattattgcgccactgttgctgcggttgtcagcgagcagatgcagggccgcaaccaggtggatatcaatgagatccagaccgcagttgaaaaccagctgatgtcggggccatacaaacaactggctcgtgcttacatcgagtaccgtcacgatcgcgacattgaacgtgaaaaacgcggtcgcctgaaccaggagatccgtggtctggtcgagcagaccaactcctcgttactcaacgaaaacgccaacaaagacagcaaggtgattccaacccagcgcgacctgctggccgggatcgtggctaaacactatgcacgccagcacctgctgccgcgtgacgtggtgcaggcacatgaacgtggtgatattcactatcacgatctcgattactcaccgttcttcccgatgttcaactgcatgttgatcgacctgaaaggcatgctgacccagggctttaaaatggggaacgccgagattgaaccgccgaaatcgatctctacggcaaccgcggtaactgcgcagattattgctcaggtcgccagccatatttatggcggcaccaccattaaccgtatcgatgaagtgctggcaccgtttgtcaccgccagctacaacaaacatcgcaagaccgcagaagagtggaacatcccggacgccgaaggctacgctaactctcgtaccatcaaagagtgctacgatgccttccagtcgctggagtacgaagtaaacaccctgcacaccgccaacggtcaaacaccgtttgtgacctttggttttggtctgggcaccagctgggagtcgcgcctgattcaggaatctatcctgcgtaaccgtatcgccggcctcggtaaaaaccgtaaaacggcggtgttcccgaaactggtgtttgcgattcgcgatggcctgaaccataaaaaaggcgatccgaactacgacatcaaacagctggcgctggagtgcgcaagcaagcgcatgtatccggatatccttaactacgatcaggtagtgaaagtcaccggttcgtttaaaaccccgatgggctgccgcagcttcctcggcgtgtgggaaaatgaaaacggcgagcagatccacgatggtcgtaacaacctcggcgtgatcagcctgaacctgccgcgtattgctctggaagcaaaaggcgatgaagccaccttctggaagctgctggatgaacgtctggtgttggcacgtaaggcgctgatgacccgtatcgctcgtctcgaaggcgtgaaagcgcgcgtagccccgatcctctatatggaaggcgcttgtggcgtacgtctgaatgctgacgacgacgtttctgaaatcttcaaaaacggtcgtgcgtctatttcgctgggttacatcggcatccacgaaaccattaacgcgctgttcggcggcgagcatgtttacgacaacgagcagctgcgcgcgaaaggtattgcgattgttgagcgtctgcgtcaggcggtggatcagtggaaagaagaaactggctacggtttcagcctctacagtacaccgagtgagaacctgtgcgaccgcttctgccgtctcgataccgctgagtttggcgtggtgccgggcgtgaccgataaaggttactacaccaacagtttccacctcgatgtggagaagaaggtgaacccgtacgacaagatcgactttgaagcgccttacccgccactggcgaacggtggcttcatttgctatggcgagtatccaaacattcagcacaacctgaaggcgctggaagatgtctgggattacagctatcagcatgtaccgtattacggcaccaacacaccgatcgatgaatgctacgagtgtggctttaccggcgaatttgagtgcaccagcaaaggcttcacttgtccgaaatgtggtaaccatgacacctcccgtgtgtcggtgactcgccgcgtgtgcggatatttaggtagcccggatgcacgtccgtttaacgctggtaagcaggaagaagttaagcgccgcgttaaacatttgggaaatgggcagataggttaatcttcactctgtgttaagcaaatgccggatgcggcgtaaacgccttatccggcctacatttggcaacggctgtaggcctgataagacgcgacagcgtcgcatcaggcgttgattaccggatgcagcctacacgcggactgataagccaggtgaaataatgaactatcatcagtactatcctgtcgacatcgtcaacggccccggcactcgctgcaccctgtttgtctccgggtgtgttcatgaatgccccggttgctataacaaaagcacctggcgggtaaattccggtcagccatttaccaaagcaatggaagaccagatcattaacgatctgaatgacactcgcatcaaacgccagggtatttccctctccggcggcgatccgctgcatccgcaaaacgtgccggatattctgaaactggtacaacgcatccgcgccgagtgtccgggtaaagacatctgggtgtggacaggctataaactcgacgaactcaacgctgcgcaaatgcaggttgttgatttgattaacgtgctggtcgacggcaaatttgtgcaggatttaaaagacccttccctgatctggcgcggcagcagcaatcaggtggtgcatcatttgcgatgataagttccctgttacctgagtgcaggcaacagggaaataaagaattaacgatacttctggtgataggcgttgcgggtcgttttcagttgctctgcggcagcctgcgcttcttttactttaccttcatttgccagcttcagcgcgtcgtcaatctgaccgaccagaatgtcgaaaccgtggcggaagtctttcatttccgggctgtccggtgatttgccttcaagcttcggcggcgtcgctttttgcgcatccagcgccgcagcgcgcatcttcgttaacgcgtctttgacttgcgccgcgttatcggctttttcaaccacttttaaattgtcgttgagggtttccatattgtcttccagatcagcggcaaacgacgccgaactgaataccaatgaggagactgcaagaatagctaacaggcttttacgcattgctcacttccttttttatttacacttcatccttcacactgcctcatcgacggctacgctcattcgcccgagtcacgtactacgagtacgctcccctgctctcattcactttccgtctcgatgcagtgcgaatgattttgtgtaattttttagtttatagcgcggcaggtcgcgccagttttttactgcccggcgattttcatctccggcaacagcacagaaccacactgtatattactgcgtgtttcaatatcgttaccgacggtgacaatattgcgccacatatcttttaaattaccagcgatggtgatttcgctcaccggatactgaatctcgccattctctacccagaagcccgctgcaccacgggaataatcaccggtaatggcactcacgccctggcccatcagctccgtcaccaccagcccggtgcccatctctttgagcatttgttcgaagcttagcccttgtccggcaatccgccagttgtgaataccgcccgcatgtccggtgcttttcagccccagtttccgcgccgaatagctggtcagcagccactgagtcaggatgccatctttgacgatatcgcggcgctcggtgcgcacaccttcgctgtcgaatggtgtagatgccagccctttcagcagatgcggatgttcttcaatagtcagccagtccggcagaatttgtttacccagcgaatccagcaagaaggtcgatttacggtagaccgcaccacccgctatcgcccccaccaaatgaccaaacaaccctgttgccacttcattggcaaaaatcaccggcgctttcatggtagaaagtttacgcggtgacaggcgcgataaggtacggcgagcacagtcggccccaacccactctggcgtttgcagatcgctcatcgcacgcccaatggtgtaggcataatcgcgctccatatcgccattttcttcggcgattacacagctggagagcgaatgacgcgttgagcagtaaccctgcaacatgccgtggctgttgccaaaaactttgacaccgtagtggctgttaaagctaccgccttcggtattggtgatgcgtttgtccgcctgcaatgccgcctgttccgcgcgggccgccagttcaatggcttcatccggagaaacgtccgcagggtggaacaagtcaaggtccggcgcgtcaaaagccagcagttctttgtctgccacgcctgcatacggatctggcgaggtataacgggcaatatccagcgccgcctgtacggtgcgggcaatggcctgcgggcttaaatcggtagacgatgcgctacctttacggttctggtgataaacggtgatccccagcgcgccatcgctattgaattcaacattctccactttaccataacgcgtgcttacgctaatgccggtggtcttgctgacggcaacttctgcaccgtccgatttgcctgaggccaactccagcgcagtcgaaactgcttcttccagaatcttgcgctgcgcttcaacttgagagattactttcattgcaagtgccataatgtagagagtttctctgaagtctaacagagaaccgtttttcagtgcgcatcttaactggtaacattagcctctttttttaaggagcctgagatgactaagcagcccgaagactggctcgacgacgttcccggtgatgacatcgaagacgaagacgatgaaattatctgggtcagtaaaagtgaaattaaacgtgatgccgaggagctaaaacgccttggcgcggaaattgttgatctggggaaaaacgcgctggataagatcccgttagatgcggatctgcgcgcggctattgagctcgcccagcgtattaagatggaaggtcgtcgccgccagttgcagctcatcggtaagatgctgcgccagcgcgatgttgagccgatccgtcaggcgctggataagctgaaaaaccgtcacaaccagcaggtggtgctgttccataaactggaaaacctgcgcgatcgtctgatcgaccagggtgatgacgccatcgctgaagtattgaatctgtggcccgatgccgatcgtcagcaactgcgaactctgatccgcaacgcgaagaaagagaaagaagggaataagccgccgaaatccgcgcgccagattttccagtatctgcgtgagttagcggaaaacgaagggtaattttcgttgttgatgtaagtatggtttgccggatacggtgcacctgtaggcctgataagacgcatcaagcgtcgcatcaggcactatgctcaaatgccggatgcggcgtgaacgccttatccggcctacacacactctatcaggctgaggctgtgaattactgcgcggcttccgctttcttcgctaacccatccagcagtttctgatgaattccaccaaaaccgccgttgctcatcaccagaatatggtcgccaggctgagcggttttcaccaccatatctgccagcgtatccacatcgccgctccagtgtgcaggctgaacgcaggcttctgccacttctgccacctgccacggaatatgtgccggttgcagcaggaagacttcatcggcacgacctaatgaaggtgccagatcgtctttgcagatccccattttcatggtgtttgagcgcggttccagcacggcaataatgcgcgccgtaccaccaactttgccacgcagcgccgccagcgttgccagaatcgccgtcgggtgatgggcaaaatcgtcatataccgtgacgccattcgcttcaccacgcaactccagacggcgacgagcgttaataaacgaacccagcgcgttagcggcatctgccggcgctacaccaacatggcgagccgccgcaatcgccatcaggccattgtgcatattatgttcgcctaccagcgaccatttcacttcgcccactttttcgccatccagcaagacttcccattcagaagcgtcagtggtcagctttttcgcctgccagtgaccttgctcgcccaccagctcctgctcgctccaacagcccatcgccatggtctgtttcaggttgatgtcgttttccggccagataatacgcccctgccccggaacgatacgcaccagatggtggaactgtttctggatcgctttcaggtcgtcaaagatatcggcgtgatcgaactcaaggttgttgaggatcagcgtacgcgggcagtaatggacaaatttagagcgtttgtcgaagaaggcgcagtcgtactcatccgcttcgataacaaagaagtcgctttcgcccagacgcgccgaaacctcaaagttccccggcacaccgccgatcacaaatcccggtttgtaaccgcattgttccagaatccaggtcgccattcccgccgtggtggttttgccgtgtgtaccggcaacggccagcacccagcggtcgcgcagcacaaaatcgtgcagccactgcggacctgacatataagggatgtttttttccagtaccgcttccacacacggatttccacgggtcatggcgttaccaataatcaccagatccggctgtggatcgagctggctggcatcgtaaccctgaatcagttcaatgccttgcttctcaagtaaggtgctcatcggcggatacacattggcgtccgaacccgttacttcatggcctaactggcgcgccagcatcgccagaccgcccataaacgtgccacaaattcctaaaatatgaatgcgcatacgtcactatccttttttaatctggcgctcattttacgcatatgtcgggcaagtgagaaacgcatttcaggataatccgtaatttgctggcgcgattcacctgagcgcaacattgggattatttgttaagattgttgcggtcgctttactccataaacattgcagggaaagttttatgaaaacgttaggtgaatttattgtcgaaaagcagcacgagttttctcatgctaccggtgagctcactgctttgctgtcggcaataaaactgggcgccaagattatccatcgcgatatcaacaaagcaggactggttgatatcctgggtgccagcggtgctgagaacgtgcagggcgaggttcagcagaaactcgacctgttcgctaatgagaaactgaaagccgcactgaaagcacgcgatatcgttgcgggcattgcctctgaagaagaagatgagattgtcgtctttgaaggctgtgaacacgcaaaatacgtggtgctgatggacccactggatggctcgtccaacatcgatgttaacgtctctgtcggtaccattttctccatctaccgccgcgttacgcctgttggcacgccggtaacggaagaagatttcctccagcctggtaacaaacaggttgcggcaggttacgtggtatacggctcctctactatgctggtttacaccaccggatgcggtgttcacgcctttacttatgatccttcgctgggtgttttctgcctgtgccaggaacggatgcgcttcccggagaaaggcaaaacctactccatcaacgaaggaaactacattaagtttccgaacggggtgaagaagtacattaaattctgccaggaagaagataaatccaccaaccgcccgtatacctcacgttatatcggttcactggtcgcggatttccaccgtaacctgctgaaaggcggtatttatctctacccaagcaccgccagccacccggacggtaaactacgtttactgtatgagtgcaacccgatggcattcctggcggaacaagcgggcggtaaagcgagcgatggcaaagagcgtattctggatattatcccggaaaccctgcaccagcgccgttcgttctttgtcggcaacgaccatatggttgaagatgtcgaacgctttatccgtgagttcccggacgcgtaagctcctgcgcctctccacacggagaggcgtttttatcgctgcgcaatgttgactcttgtcactggcgaactctgacgattctcccacagcaccgttaatccacgctgtaatgctataaaaataaacaacaaaataccgatggcgattttcgtccaccaggaactcagcgtgccatcaaagtttatgtaagtctgaatcagtccctgaatcgccacgccaaaaagcgtccctaataccgttccaacgccaccactcaaaagcgtaccgccaattaccactgaggcgatagcatccagttccacacctacgcccgccagtgcatatccggcctgggtataaatcgagaagacaatccccgccagcgttgccagtccggtggagagcatataaatgcgaatagtggtgctgcgagtggaaatccccatcaggtttgccgacgttgcgttaccgccaatggcgtatacctgattaccaaaacgggtacgatgcgcgaggaatatgccgataaccaccaccgccagcatcagcagtcccatcgcacttaagcgaccaccgccagggattttccacgcaaggcttgagagcgtgtcataaacaggatggtttatcgggatcgactcttccgaaacgagatagctgacgccacgcaaaaagaacattcccgcaagggtaatgataaacgccgggatcttcagggcgtcaatcagaagccccataaatgcgccgaaggcacagcccatcaccaacaccagcggaaacgccagcaacggcgagaggccgaaatcgccaatcacttttgccagaaacacgccggtaaaggcgatcaccgaaccgacggagagatcaatcccaccggagaggatcacaaaggtcataccaacggcgattatcccaagaaaggcattatcggtcaggatattgcagatcactcttgtggaagcaaaaccgggaaactgggtcagacagtagatataacccaacacaaagacgccgatggtgatcatcagtggcaaattacgttttatcacggttacgtacccctttaatcagactgataaagcgttgcgactggacaatcagcacgcaaagcaccaccaccgctttcaccacctggttcatctccggcggaaagccagaaagcaaaattccggtgttcattccctgaataatcagcgcccccaccaccgaaagcagcaggttaaagcgcccgcccatcagcgatccgccgccaatcaccactgcgagaatggcgtccagctccagccataatccggcattgttggcatcggcaccgcgaatatccgccgccacgataatgcccgcaatcgccgcacatagcccgctcaacacgtaggtgagcatgacgatgatccgcgtgtttaccccggcattttttgccgcccgaatgttgataccaacggcttcgataaacatccccagtgccgttttgcgggtcaacagccagaacaggagaagcgtcagcaccgcaataatgactggcgttggcaggaacaacagcgatccactgccgaaccaggagagatccggtgagttaaatgtgacgatctgtccggaggtgatcagttgcgccacgccgcgcccggcgaccatcaggatcagggtggcgacaaacggctgaattttgaggatcgctaccagtatgccgttccacaatcccgccaggatgccagtgcccagggcgcttaacaaaacaattggcaggctgaatcccgcgaccgtcatcgcagccgttgtggctccggcgatagccatcaccgcccctacggagagatcaatcccaccagtggcgataaccagcgtcatgccaatcgccagtagcgcaacgggggccgcacggttaagaatgtcgatagggctaccgaacaaacgcccatcctgaagcaccacctgccagaaatgcggggccaccaggctatcaaccagcagcaccagcaacagtgccgccagctgcggcattcctgttggccagcgaaaacgccttttcggcggcgtagtgtccgggagagattgaggcatcacactattctccttacgccgcaatggcgttcatgatcgccggaacggaaagctctgccagcgggatctccgctacctgtttgcgatcgcgcatgataatcacccggtcggcatagcccaccagctcttccagctcggaggagatcaccagcagcgccagcccatcggcgcacagcgtttcaatcaggcggatgatctcggcgtgggcaccaacatcaattccgcgcgttggctcgtcgagaatcagaaattgcggtcgggtcagtagccaacgtgaaagcaacactttttgctgattgccgccggagagaaattcaatcggttgttcggtggaaggtgtgcgaatgccaagctggcggataaagcgttcggcaatctcttgctgctctttgcgggaaataggtcgtaaccagccgcgctgggcctggagagcaaggatgatattttcccgcaccgaggcggcagcgatgatgccatcggttttcctgtcttccgggcagaagccaatgccaagaaccgaagcctgatgtggcgagcgtagcgtttgcagtttgcctttgatcaacgccgtgccgctatcagcaggtttgataccgaagatcacttcggcggtttcggtacgtcctgatcccagcaagcctgccagaccgacgatctcgccggggcgtacttcgagatcaaacggcgcgatcgttccttttttgccgtaattcttgaacgcggcaacaggtttgtcgctcagcaatgttctcccggcacgctgaagcgcgtgggtgtccagttcacgccccagcatcatttttaccagttcgatctgcggtagctcgcgcgtttcccgacagcctacgaaactgccgttacgtaagacggtgatccgatcgctaacctgataaacctgatcgagaaaatgagtgacgaagatcagactgacgccgcgatcgcgaagttgacgcatcaggccaaacagtaactctacttcctgagtgtcgagactggcggtgggttcatcgaggatcagcactttggcggagagatcgatagcccggcaaatggcgacgatttgctgcatcgcgactgaaaagcggttgagcggttcgcgcacgtcgagggagaaaccgtaagatgccatcagttcggtggcgcgcttttctatctctttacggcgtagaaggccgaaacgtttgggttcgcgacctatgaatagattatcagcgaccgacatattgggtagcaggttgacttcctgatagacggtgccgatgccgagttgttgtgcgtgggcggtgtttttcggtgagatagcctggccttccagccagatggtgccgcgatcggcgtggtatacaccggttaatgctttgatgagcgtcgattttcccgccccgttttcaccgagcagcgccatgatttcaccacggcgcaggctgaaatcaacgttgtctaacgctttgacaccggggaaaaatttacttaatccttcggtgcggaggatttcctggtgttggtcggtcgtcatggtttcccccggtgtaaagcgtgctcccagtaggcatgataagacgcggtaagcgtcgcatcaggcttcagcgcaccaccgccggatgcggcgcgagcgccttatccggcctacgaatcggcatcaggcatagcaaccctcaataccccatatttttcttcttctctaactcttcttttgcggtatcaggcagataaagggtggatttggtcagggttagcttttcaggcatggtgccgtcttttttatatttctccagcgcatcgaaagcaggacctgccatgttcggcgtcagttcaacgctggcgttcgcttcgccatcaatcatcgctttgtagatgtccggcacgccgtcgatagagcctgtcaggatatctttgcccggtttcaggcccgcttctttaattgcctgaattgcaccaatcaccatgtcatcgttatgggcgtaaaccatgcagatgtttttgccgttgttttccgctttgataaagctctccatcacttctttgcctttgctgcgggtgaagtcacctgactgcgagcggataattttgatatttggcgcattcttaatggcttcggcaaagcctttcttacggtcaatggcgacgctggccccaacggtgccctgcagctccaccacgttgcatggtttgccattcacttcttttaccagccagtcaccaatcaacttgccttcgaggatgttgtcggcggtgacagtggtcatatagagagatttgtctttcacatcgatggaacggtcaagcaagaagaccgggatttcggcatctttcgcctcttttaataccggttcccaacccgtcgccaccaccggagcgataaagatcgcatccaccccttgtgcgacgaaggaacgtaccgctttaatctggttttcctgcttttgctgaccatcggcaattttcagtgtgataccgcgtttttcggcttcacttttcgccacattggtttctgcggcgcgccagccggattccgatccgacctgcgaaaatcctacggttaatggagcggccaacgccatagacgacatggctgccgagactgcagagactacaagtaagcgtttccacatagggttgtcctcgtcggggtaattattattggtgaaaagatgttcgcgaaaaaactatagacaattcgttatgtaacggattgcgttacatcacacttcaaaaaagtaaataaaacgttaatcacaagtttgtaatcgctttcatctcactatgaaaaatgcggctacggttatggattttcctgctctgtataccgtcttaaaactggcgaaaaaggaaaatgaagacgaaaacaagcgaagacattcggcgcgagttggctataatactcggcacttgtttgccacatatttttaaaggaaacagacatgagcttactcaacgtccctgcgggtaaagatctgccggaagacatctacgttgttattgagatcccggctaacgcagatccaatcaaatacgaaatcgacaaagagagcggcgcactgttcgttgaccgcttcatgtccaccgcgatgttctatccgtgcaactacggttacatcaaccacactctgtctctggacggtgacccggttgacgtactggtcccgactccgtacccgctgcagccgggttctgtgatccgctgccgtccggttggcgtactgaaaatgaccgacgaagccggtgaagatgcgaaactgattgctgttccgcacaccaagctgagcaaagaatacgatcacattaaagacgttaacgatctgccagagctgctgaaagcgcaaatcgctcacttcttcgagcactacaaagacctcgaaaaaggcaagtgggttaaagttgaaggttgggaaaacgcagaagccgctaaagctgaaatcgttgcttccttcgagcgcgccaagaataaataagttcttctggcgcaataaccctgaacaccgggcttcggttagtaagggttttttatgcccgcaatttataaactctctactccactattattattttcagcagttgaaaggcttgaacggtaagaacaagctaagctcgaccaccattttgctgttcatagccacttgctggaagttagccggcctcactcatactcaccgttcaaagcgtgcccccgttttacccctgcacatttgttaacgccagcagagttttttatgcgattgcagatatggaaagcggcccggagagaaaagcaaaagatgggaaagttacaaaaaaaatcgcgagatacatcgcataaaacaacgccacccgaaggtggcgtgcttttattattacttatccctgtctaaccagtcgccgctttcaattagctttaatccatcgacgggtcgttgataaacgtacatccatgcactcccgtacggcgtctgaatcaactggcgcgcgtattcaccgcccctggtgcgcaaggcatcaagttcggccagcgtggcgttgtcaatacgataaacttcaccgtgtactgttccgttccccggaactgcgcctggatagtggcccaggctatacaactggtagttatcaatactgaaatcgcccagtaactgggcattggtcatccagtgactgttgccttgtttgtggcgtaaactgccgtagacaaatattcgcattgctaaaactcgaactgatagagcaaatccagtgcctggtctacaccagacacggcttccagatatagcttaggcatcaggcgataacgtaacgtgagtgttgctatagagtcaaatatacccacgccgtatttcacttgcaggcctggcaatacatagccgctgaccaccacctgggaggagtcgccaactccctcggtgtcgagcgctaaattgcttacgccaaacgtctcgccgattttacccacaatctggccactttgcgcaacccccaggccaatcagcatcgaggtcatcgccgcgctgtcgctctgatcgctctccagcccttgtccacgtagcaaataagacaatgcagcttgttgcgacatcgccgggtcagagaagatctccgctttcggttcgtccgccagaccagtgacgcgaactccggcgatgacgtcgtcttctgtagcatccgggttacgaatagcttcgatattaagatacggttgatctggcggaccagagaacagtagctcacccttacgcacaatcagatcctgaccataggcatggaagcgcccttcagggatgttgatctgcccgttcaggcccagcccttgtttgtcctgaacgacgttgagatcgcccgtcagccgcgctttcaggccaaaggcgtcaatgcgcacattgttgccaacgtggacagtcaggttactgttaatcggaatcgacgccgttttcggctcttccggttgcaggttatcgttaagcatcaccacatcgctggaaacgcctactgcgctttccggcagatcgtgcaccacgatgcgcgcccacggaacatccacgcgaccatcgagggtaaacaggtttggtgtagcctcgaatacaacatctggcgatacatccattcgtaccatcggcggcacggtgatacgcactttactgcccttcgctgttacccgcgcccgccagttttcaatctggctccagtcggcatcaccgttcaggtagatttcaccctgctgggtccgcacggtacctgcaagcgtcgagcgcataccgttaaagttgaccgcaagctggctcggttgcatatcaaacggcataaagttgccgtcgatatccacccccgtaacctgaagctgaccaaacaactgcgggctttgcacatcaccacccagacgcaagttggcactcaccatccccgcggctttttccccacgggtaaagatggggtttatcatcgcaaggttgaagttacggatattgacgttgccaccaagattacggcggccttgcggatcggtcacctgcacctgaccatcaaactggccgttattggtcaggcggatggtccagcccaattcggcacggttgttacgcaactccgccgtcagattcagcgtctgaaacgccacgggcagcgccgcatcgttgacggtttgcgtcacctgcacattacgccccgaaagggtgatactgccctgcggcagcccctctttcgtggtgtcccaggcaacgtccgctttacccgtgaagataccgctggcctgagtggtttctggcataaatggtttcagcatggccaggtcgaagcggttgagattcaccaccgcacgcccttcggcacccgcatcgatagtttgcggcacgcacagttccgcattcgggttaagccagcagtgtggcccgatgctgattttttgctccttattgcggtaatccagcgcaatatcgcgggtcagcgaccacgggccgaccggcgtctggaagcgggtattgctaagagttcccttccagcgttcttctttgcgatcaaaacttcctgccagattaagctgcccggagacaggctcgccctgaatccgcaactgtagctcgtgctgcttttcactgcctttggcattcagggtgacgaggttgatatttacatccggttgcgaaatttgctcaacgcgtacgtcgagtttcccggcgatctgatcggtggatttaatgtcgccttccacgcgaacctgcgccacggaaagttcctgccagcgcaggccgcgcgcggtgatatctgccagtagttgtggcgcttccaccgtgccgcgtactttcaccagccctttcgctgtaccgccaagccccggcagcgcgttatccagccccggcgcgttgatggtggcatcaagattgagatcttttacccccagctcgcctttcacttcggcactgtttggccccagttccagatgcagccctgggatcatccactgcatataactgttgcctttcagcgtgccgtcaacgttcactttgttctgtttgacgttaccggtcagcttcagttctggcacctccatctgccaggtgccgccgtacaggctaccgcgggttttaatcaagccattgagtttcgacggccactccgggatctctttggcggtgttaatgccgttaagcgttagctcaccgcgccaactaatggcctgctgccagtcgagcaacgccttaagttccgttttcccttccagcgccgcgacggtaagtttgtcgagattgacctgctgttcattacctttggcatcaagggtaatggtggctggcgggatctcctggcccttaacagccgtgcgcatagagagcgtgtaatcggtcattttgccggtaagtttcagtttcagatcatccgcctgatactgcttctcaccagtgaacggccagtaaagctgtttgctgttcacttccacgttgagcggcaatccggcttccgccagtcgcgtctgggcgcgtaaatccatatccaccggaccggaaaggttaacgcctatctccagctgttcgcgcagcgcaccgcccactttcagcttcaccttttcacctttcaacggctccacgttcagtgtgctgttgagggtgatatccaccggccagttgtctgacagctgcgccgtgccgctggcgttgacgatcccttgactggagtcgatatccagggcgtccagtttagtattgccgtcaatgctgctcactttcagcagcatggtgctcacggtgatgtccgtgtcgcccgtcacgcgcagctgctcgcccttaaactcttcaatgttcaggttaagcggcaaatgcacgtcggtcatttccggcaataccgggcgagaaaagagatctttcagcgtttcgccgagcggcttttcctccggctgtggattttcaattttcggttcgaccacttcttcctgcgccgcttccgccactttcggcaaagcaatcaacaggcctttcagcgatgtcggtttcagggtcagggttttctcctgccagttgaggccggaggtgaagtccatcaccgataccgtggtgtcatcaatcttgatgttgacgttgtccagcgccacccgtgtcagggtaatgggatacggcgtggagagatccagcggaccgctatcttcctcttcttcaacctgttcagaaggaggcatttttttactgtcgatgttgacctgaatgtctttcagcgccagatcattaatacaaacgctactgttccacaggcactcaagcccgaccgccagatgcagattgcccgcttttaccgccacgcctggctgctcataacgaacgtcagacaaggtgagatcacgccagccgccggtgaccttgccaatatccagtcctggcacccagcgatccgccgctttaaataccagatgcaggccgctggtggtgcccaccagaaacgccaccgatcccagcaacagtaagataacgataaccacgccgaggctgatttttttccataaactcataattctggccccagaccgatgtaaaactgtaacccgtgttcgtctttatccgcgaccggtacggcaaaatcgagtttgattggcccgaccggcgattcccagcgcacgccgacaccggtaccggttttaaagtcgctgcggcgaatatcgcttaccgcttcgccgctatcgacaaacaccgcgccccaccattttccggtcacgttgtactggtattccagcgatccggttatcagcttcgaggcccctttcaggtcaccgttggcgtatttcggggcgatagatttgtatttgtagccgcgaatactgcgatcgccaccggcgaagaaacgcagatccggcggtactttgtcgaaatcacccgtttcaatccagcccaacgtgccgcgtgtcacaaaacgatggcgatcgtacagtgtgcggatccagacgttctgcgcctggaaaacggagaaatcaacatccgagccccaggccgtgttggagtagtcgatagagtagcgttgcgagtcgccccaggttggcatcaggccaccacgagaacgcgtgcggctaatcatcaccccaggataaaacagcatcgtggtgttggtaatttcaccctgggtaaagtggtcgaaactccagcgcaggttaatggcacgctgccagccgctggagagatcccagtagcgagaagccaccagcgtagtggagtcagactcggtatcgttcaggtcagtgcgcttaaaaccgccctgcaccaaataatattgttccagcggattcttcagcagcggcattttatagctgaagtcgaggatctgttccggcgcggaaatactggtactggtggtcaaactgtgaccgtaagagttcatccacggctttttccacgtcgctttcacgcgcggtcccacgtccgtagagtaaccgacgccggtttcgatggtgttttctgttcgcggcgaaaccacgcccgtcaatggtaatactttcgtttcgcgcgctttatcaaattgtggagccaccaccaccgagttaaaccagccggtagcagaaagtcgacggttcagttctgccagatctttcgattcgtactcatcgccctctttaaacggcaccagattttgcaggtattcatcgcggatttgtgatccttcaaaggtcacatgcccaaagcggtaacgttcgccactgttataatcaatatcccagaaggctttatgcaggccgagcgcaatgcccagctgtgctttggtaaattcgctatcgaaataacctttacgtaacgcaatgctggttaaggactttttgaaattttcataatcgccctggttcagtaccgtaccaatagccgggcgagtatcgagcaatttcaaatagtctttatcggtccgcgcgccgccgcgcaataccacatcggtgccgccaattaacaccggcacgcctggcgtgactttggcgatcaatacctgccgccctttctttggcggtggacggagatcaaattcaatggtcggctggtaatagcccagcgctttcagaccttcgcggatggcatcatcgacgcgtgcgcgaaagcgacggtctggcgtcacttcatcactttcaatcgtagaaagctgcgcgcgaacgttcttttccagctgtcccgataacccctcgacctgtagacggacgttcgcggcgacggcagatccgcttaagcagagtaagcttacacagcataactgtcggatatagcgcacattttctcctgaatatcctttttttcctgcccctggaacgccgttaaacggcttaacaaaaatccagtaatatggattaaaaagcagactaaacccaaaatatttcttatgttttactttagacctattcacggtggttattgtgtgcaaatacgcctcttgttacaaccttaaccccaatgaccgattttcgggagagcgacaccatgagtttatttgataaaaagcatctggtttcccccgccgatgccctgccttgacgtaacaccccgatgcccgtagccacactgcatgcggtcaacggtcactcaatgaccaatgtacctgacggaatggagattgccatttttgcgatgggttgtttctggggtgtggagcgtctgttctggcagttacccggcgtttacagcaccgccgcaggctataccggcggctatacgccaaatccgacttatcgggaagtgtgctccggcgatactggccatgccgaagcggtgcgcattgtttacgatccatccgtcatcagctatgagcagttgctacaagtattttgggagaatcacgatcccgcccagggaatgcgtcagggcaatgaccacagcacgcagtatcgttcagcgatttatccgctgaccccagaacaggatgccgccgctcgcgccagtctggaacgttttcaggcggcgatgcttgccgccgatgacgatcgtcgcatcaccacggaaatcgctaacgccacaccgttttattatgccgaagatgaccaccagcaatatctgcataaaaacccgtatggttactgtggaattggcggaattggcgtctgtctgccgccggaagcatagcgttacgggtacaaatgtagattgttgataaagtgcattttgtttatgccggatacggcgtaaacgccttgccaggcctacaaaatcgtccaaattcaatatattgcggggactgcgtaggcctgttcggcatagcgcatcaggcagtttttcatttttcagctgtctgaattttaaccctctggcggctttacagtaccttacgctatactagccactgaaaatgccggttcactttcttcgaatcggctttcaatgtgtatttcacacaaattaatcaacttccccttccgaggatctggcctgaaaggtcggataagatatgttaaacagtattttagtcatactctgtttgatcgctgtaagtgcgttcttctcgatgtccgagatctcgcttgccgcctcacgcaaaatcaaacttaaactgctggctgatgaaggcaatataaatgcccaacgcgttctgaatatgcaggaaaatcccggcatgttctttaccgtggtccaaatcggtctgaacgcagtggcgattctcggcggtatcgtcggtgatgcggcattttctccagcttttcacagcctgttctcccgctatatgtcggcagaactctctgagcaactgagctttattctctctttctcgttagtgactggcatgtttatcctgtttgcggatttaaccccgaaacgcatcggtatgattgcgccagaagctgtggctttgcgtatcatcaacccgatgcgcttctgcctgtacgtttgcaccccgctggtgtggttcttcaacggactggcgaacataatcttccgtattttcaaactgccaatggtacgtaaagatgacatcacttctgatgatatctacgcggtagtggaagccggtgcgctggcgggcgtgttacgtaaacaggaacacgagctgattgaaaacgtctttgagctggaatcccgtaccgttccgtcttcaatgacaccgcgtgaaaacgtgatttggtttgatctccacgaagatgagcaaagtctgaagaataaggttgcggaacatccgcactctaagtttctcgtctgtaatgaagatattgaccacatcatcggctatgtcgattctaaagacctgctgaaccgcgtgctggctaaccaaagcctggcactgaacagcggcgtacaaattcgcaacacgctgattgtgccggatacgttaaccctttcagaggcgttggaaagttttaaaaccgcaggtgaagacttcgcggtgatcatgaacgagtacgcgctggtagtggggatcatcaccctcaacgacgtgatgaccacgctgatgggcgatctggtcggccaggggctggaagagcaaattgtcgcccgtgatgagaactcatggctgatagacggcggcacgcctattgacgacgtcatgcgcgtgctggatattgacgagttcccgcagtcgggcaactacgaaaccatcggcggctttatgatgtttatgctgcgtaagatcccgaaacgcaccgattcggtgaaattcgccggctacaaatttgaagtggtggatatcgataactaccgcatcgaccagctgctggtgacccgaatcgacagcaaagccaccgccctttcgccaaaactgcctgacgctaaagataaagaagaaagcgtcgcataaccccagaaacatcaacggctcctgaatcaggagccgtcttattactgcatagcactttttactgcatagcactttggttaagccatctctgtttgcagacgcataacctgacggttaacttcggacatcactgacaaatgcagcttatccttcacttttgggataagaatcttacccttatcaaattcaaaagcgccaacgtccttgatgtataaccgtccacggaacaggatctttacgtacttcgccacctgaagtgggttgtaccgttggaaaattttcattgttatctcctgctgagtattacgcctttgcggtgccacaatcagcccaactattatgaggcgcaaattttaatgcctagtgactatagactatccgggcaatgtttccaccgcgtataactttttttacctaaaggttacaattattcagaattatctttttaccgaagcgcggtcttcagtataagcattcatttttcatatgatttgtgcgcttgaccgcaaactggcatcacacttgcgggaaattcgataaatagcacatatgattaaaactcagacccaagtggtcggatcacctgcatatcataagaaggaaacaccatgaccctacgcaagattctggcactcacctgcctgctgttgccgatgatggcttccgcacatcagttcgaaaccggtcagcgagtgccgccgattggcatcaccgatcgtggcgagttggtgcttgataaagatcagtttagctacaaaacctggaacagcgcgcagttagtgggaaaagtgcgagtactgcaacatattgctggtcgcacctctgcaaaagagaaaaacgcgacgctgattgaagcgattaaatcagcgaagttaccgcacgatcgttaccagaccaccaccattgttaacaccgacgacgcgattccgggttcagggatgtttgtgcgcagcagtctggagagtaataaaaagctttatccctggtcgcagtttattgttgatagcaatggcgtcgcacgcggtgcctggcagctggatgaagaaagttccgctgtagtggtgctggataaagacggtcgcgtgcaatgggccaaagacggggcgcttactcaggaagaggtgcagcaagtgatggacctgctgcataaattaattaataaatagacactctgaaccccggattcaggaacgactcgcgcggagtgtaatccagcggtttaccctgccagtcgtgaacgtgcgctccggcagctgcagccacagcatgaccagcggcggtatcccaaatattcgttggcccgaaacgcgggtacagctgcgcctgtccttccgccaccaggcagaatttcagcgaagagccgatggacgtggtctgatgttcgccaagctgttgcagatactctttcagctccgcatctgcatgggaacggctgattaccaccagcggcgggcgcgcatcgcggacctgaatctgcttgcgcacaccgcactcttctttccaggctttgccttctgccgcgctgtacattacgttcattaccggcgcatacaccacacctaaaatcggtttaccgtggtcgatgagcgcaatgttaacggtgaattcgccattacgtttaataaactctttagtaccatccagcgggtctaccagccagtaacgctgccagtgctgacggacttcccaaccgggaggatcttcttcagaaaggaccggaatatccggtgtcagcgtacgtaaaccgtccatgataacggtgtgagcggcaatatccgctgccgttaccggagaattgtccgctttgctgacgacgtccatcggtttcgtcccgtcgtagacctgcataatggcatcgcctgcattccgtgcaagctggcatacttgatctaacatttctccacctcgtctctgtgagcggtgttaacttattgttttacttataccctatcgttaatgaatgcgccaactgtgatagtgtcatcattttcaaagcgtaaaattgtggcattcttcactgttctataagtaagacgtttattctcccttttctttcgtattcccgatgataaaaggatgtccctgatgattaagtttagcgcaacgctcctggccacgctgattgccgccagtgtgaatgcagcgacggtcgatctgcgtatcatggaaaccactgatctgcatagcaacatgatggatttcgattattacaaagacaccgccacggaaaaattcggactggtacgtacggcaagcctgattaacgatgcccgcaatgaagtgaaaaacagcgtactggtcgataacggcgatttgattcaggggagtccgctggcagattacatgtcggcgaaaggattaaaagcaggtgatattcacccggtctataaggcattaaatacgctggactataccgtcggcacgcttggcaaccacgagtttaactacggtctggattatctgaaaaatgcgctggcgggagcgaaattcccttatgtaaatgccaacgtcattgacgccagaaccaaacagccaatgtttacaccgtatttaattaaagacaccgaagtggtcgataaagacggaaaaaaacagacgctgaagattggttatattggcgtcgtcccgccacaaatcatgggctgggataaagctaatttatccgggaaagtgacggtgaatgatattaccgaaaccgtgcgcaaatacgtgcctgaaatgcgcgagaaaggtgccgatgtcgttgtcgttctggcgcattccgggctgtctgccaatccgtataaagtgatggcggaaaactcagtttattacctcagtgaaattccgggcgttaacgccattatgtttggccatgctcacgccgttttcccaggtaaagattttgctgatatcgaaggggctgatatcgcgaaaggcacgctgaatggtgttccggcggtaatgccaggcatgtggggcgatcatcttggtgtggtcgacttacaactcagtaatgacagcggtaaatggcaggtgacgcaggcgaaagcggaagcacggccgatttacgacatcgcgaataaaaaatccctcgcggcggaagacagcaagctggtagaaacactcaaagccgatcacgatgccacacgccagttcgtcagcaagccaatcggtaaatctgccgacaatatgtatagctatctggcgcttgtgcaggacgatccgaccgtgcaggtggtgaacaacgcgcaaaaagcgtatgtcgagcattacattcagggcgatccggatctggcaaaactgccagtgctttcagctgccgcaccgtttaaagttggtggtcgcaaaaatgaccccgcaagctatgtggaggtggaaaaaggccagttgaccttccgtaatgccgccgatctttatctctaccccaatacgctgattgtggtgaaagccagcggtaaagaggtgaaagagtggctggagtgctccgccggacagtttaaccagattgatcctaacagcacgaaaccacagtcactcatcaactgggatggtttccgcacctataactttgatgttattgatggtgtgaattatcagattgatgttacccagcccgcccgttatgacggcgagtgccagatgattaatgccaatgcggaaaggattaagaacctgacctttaacggcaagccgattgatccgaacgccatgttcctcgttgccaccaataactatcgcgcttacggcggcaaatttgccggtacgggcgacagccatatcgcttttgcttcaccggatgagaaccgctcggtgctggcagcgtggattgctgatgagtcgaaacgtgcgggggaaattcacccggcggcagataacaactggcgtttagcaccgatagctggcgataagaaactggatatccgtttcgaaacctctccgtcagataaagccgcagcgtttattaaagagaaagggcagtatccgatgaataaagtcgcgaccgatgatatcgggtttgcgatttatcaggtggatctgagtaagtaaaacacttctttttcggcctacaaatcatcaaccgcatccggcatttattggcggatgcgatgctgacgcatcttatccgccctacaagccatgaaccgtagtccggataagcgcagcgcatccggcagttatgccgcacgttcatcccgcaccgctaacacctcgggcaaattcaactcaatccagtccgccagtgcagcaaccttttcgctcacctgctcgcccagcggcgtgaggctatattccacatgcggcggcaccaccggatacgcgatacggttaagaaaaccatcctgttctaatgcctgtaacgactgcgcaagcatcttttcactcaccccgcccattttgcgccgcaggtcgctaaagcgatgagtaccttcgcgtagcgccaccagaatcaacaccccccaacggctggtgacgtgtttcaacacctcgcgcgacgggcactgttccgcaaagagatttccctctttcagttgttgcgacaggctaatctgactcatttcatacttacctttttgtacgtacttactaaaagtaagtttaagtgttagcgtatttaaacacaagacaaaacgatggagacttcccatgatcgctattactggtgccactggccaacttggtcactatgttattgaatccttgatgaaaacggttcctgccagccaaatagtggctatcgttcgtaatccggcaaaagcacaggcactgacagcacaaggcattaccgtgcgtcaggctgattacggcgatgaagccgcactgacatctgcgcttcagggagtggaaaaactactgctgatctcttccagcgaagtgggtcaacgtgccccgcagcatcgtaatgttattaatgccgcaaaggcggccgacgtgaaatttatcgcttataccagcctgctacatgccgattcctccccgctcggcctcgccgatgagcacatcgagacggagaaaatgctggctgattctggcatcgtttacaccctgctgcgcaacggctggtacaccgaaaactacctcgccagcgccccggcagcactggaacacggcgtatttatcggtgccgcgggcgatggcaaaattgcctcagcaacgcgggctgattatgcggtagctgcggcacgcgtaattagcgaagccggtcacgaaggcaaggtttacgaactggcgggcgatagtgcctggacgctgacacagttagcggcagaactcaccaaacagagcggaaaatcggttacctatcaaaatctgagcgaagccgatttcgctgcggcgctgaaaagcgtcggactgcctgatggactggcggatatgctggcggattctgacgttggcgcatcgaaaggcggtctgtttgatgacagcaaaacgcttagcaaattgattggccgcccaacgacaacgttagccgaaagcgtaagccatctttttaatgttaataactagttaattaaagtggcatcctcccgcatcctctctgataatgacgggatgccgggagcaatcatgtctgcttcctgaatatttcttctgacagaccagtggatgccagtgatgattagcggcgtgctgtacgccctgttagcagggttgatgtgggggcttatttttgtcgggccgttgatcgtgccggaatacccggcgatgttacagtcgatgggccgttacctggcgctagggttaattgcgctgcccattgcctggctgggacgcgtgcgtctgcgtcagttggcgcgtcgcgactggcttaccgccttgatgctcaccatgatgggcaaccttatctattacttctgccttgcaagtgccattcaacgtactggcgcgcctgtttccacgatgattatcggcaccctgccggtggtgattcccgtttttgccaatctgctttatagccagcgcgacggcaaactcgcatggggaaaactcgccccggcactggtttgtattggcatcggcctgtcgtgtgtgaatattgctgagttaaaccacggactccccgattttgactgggcacgttatacctcaggcatcgtgctagcgttagtttccgtggtctgctgggcatggtatgccctgcgcaacgcccgctggctgcgggaaaatcccgacaaacatccgatgatgtgggcgacggcgcaggcgctggtcacgccgccggtttctctcatcggctatctcgtcgcctgttactggctgaatatgcaaacgccggacttctccttaccctttggcccccgtccgctggtgtttattagtctgatggttgcgatagccgtgctttgctcatgggttggcgcactctgctggaacgtcgccagccagcgattaccgacagtgattctcgggccgctgattgttttcgaaacgctggcaggtttgctgtacacctttttactccgccagcaaatgccgccgctaatgacgctgagcggtatcgcgctgttagtgattggcgtggtcatcgcggtcagagcaaaaccagaaaaacctttaactgaatctgtctcagaaagttgacacgctggcagtgagttaaataagcctctgctacgtaagggttatagcttttgccttaaagatgcatttaaaatgcatcttatcttattaagaatgaggtatcagctatggcttatcgcgaccaacctttaggtgaactggcgctctctattcctcgcgcttcggctctgtttcgtaaatatgatatggattactgctgcggcggtaagcaaacgctggcgcgtgcggcggcacgtaaagagctggatgttgaggtcattgaagctgagctggcaaagctcgctgaacaaccgattgagaaagactggcgtagcgccccgctggcagaaatcatcgaccatatcatcgtgcgctaccacgatcgccaccgcgagcaactgccggagctgatcctgcaagcgactaaagtcgagcgcgttcacgccgacaaaccaagtgtgccaaaagggctgacaaaatacctgactatgctgcatgaagagctttccagccacatgatgaaagaagagcaaatcctcttcccaatgatcaaacaaggcatgggcagccaggcaatggggccaatcagcgtaatggaaagcgagcacgatgaagcgggcgaactgctggaagtaattaaacacaccaccaataacgtcacaccgccgccagaagcctgcaccacctggaaagcgatgtataacggcattaatgaactaattgatgacctgatggagcatatcagcctggaaaacaatgtgctgttcccgcgcgcgctggcgggtgagtgatctaaaagctggatggcattgcgccatccagcatgataatgcggttatttccgcagttcagcagcccgcttcttaccaataaacagccagcccagccccagcgcgataaaccacagcggggtaaccagcagcgcctggcgggtgtcatcttccagtgtcaacaacaccagaacaaacacaaagaacgccatacatacccagcacatcagcttgccgagcggcatcttgtagattgatttctcatgcaggtgcggacgctgtttgcgatacaccaggtacgagcaaaggataatcgtccagacgaacataaacagaatcgcggaaacggttgtaatcatcgtgaacgcgccaatcacgctgggattcacatacaacatcaccacgccgccgagcaggcagatgcaggagaaggtcagccctttcgcgggtactgcgcgcttagagagtttagcgaacgctttcggtgccacaccttcctgggccagaccaaacagcatacggctggtagagaagacaccgctgttagcggaagacgccgcagaggtcagcaccacaaagttgatcacgctggcagccgcaggcaaacctaccaacacaaacagttcaacgaacgggcttttctccgggactaccgaactccacggcgtcacggacataatcacaatcagcgagaagacgtagaacataatgatacggatcggaatggagttaatcgcgcgtggcagtgatttctccggatctttggtttccgcagctgttgtacctaccagctcaatccccacgaaagcgaaaaccgctatctggaatccggcaaagaagccgcttaagcctttcgggaaccagccgccgtcattccacaaatgtgcaaatgatgcttccacaccggtcggtgactgaaagtgcatcgccaccatgaccaggccgacaacaatcagcgacactatggcgacgattttgatcatcgcaaaccagaactccatctcaccgaacatttttaccgtggcgaggtttagaaccagtaacagaatgatcacggataacgaagcaacccagtcagaaagcccagggaaccagaattgcgcataggcggtaatggcaaccacgtctgccataccggttacaacccagcagaaccagtaagtccagccggtgaaatatcctgcccacggcccgagtaaatcggaagcgaagtcactaaaagatttgtattccagattcgaaagcagcaattcccccattgcccgcatcacgaaaaagagcataaaaccgatgatcatataaacgaaaatgatcgacggcccggcaaggctaatcgttttgccggaccccataaacaaccctgtaccaatggcaccgccaatggcaataagctgaatatgtcggtttgtaagattgcgccgtagcgactgttcagccggagcctgatcatcggcaacgacttttacctgatctaccatgtttttttcttcctgtacctgtctgtgttgttcaggctctacggcctttagtcagtctatgatacgacgaatctgtatcgggactcatcgatattaggtaacaatacgcgggatgaatactaagatttagatctaatgttaattttatgtttaaagtgagtgtcatatcacggtgataacgcgaaacagctcacaaaaatacacgcttacagggtctttgcaacataaaatagcgccgtttggcaaactgaagggtttattgctgaatgcctgctcccctctggttcgaggggaacagaatgcgctgcttagaggatttccagcagttcgacttcaaacaccagggtgctgaacggagggatggacgcgcctgcgccacgctcgccatatgccagttcctgcgggatagtcagttcccatttagaacctaccggcatcagagtcagtgcttcaatccagccagggatcacgccgttaaccgggaattcagctggctcgccgcgagcaacggagctgtcaaacacggtgccgtcgatcagttttccggtgtaatgaacacgaacgcggtcggtacgtgccggaattgcgccttcgccctggttgatcacgcggaattgcaggccagattcggtgctatttacaccttcttttttggcgttttcttccaggtatttcacaccttcagcagccatcgcctggaaacgctgacgacgaacggcatcggcgcgttcgtggatttcacgcagcgcgcggtgcaccacatcaaccggaacagccggatgtttgccttccagcgcatcggcaatgcctgcaaccagtgcttctggcagcagcccttccaggccagattcactcagttgttgccctacctgcaaaccaatgccgtagcttgcttgcgcttcgatggtgtcaaaagttggggtggtcatcgtatttcctttcttagggtataaagtagcgggcagcatatcagccacacttctttgggtaaaactttgtcgcgggaatgatgacaaatcccggggaaaaagaaacaatagcaatatcccgtatgaatataataaaggcgggtttaccacggacatcatagcgttagcttattcataggctatgattgaggaacaagacgcggagcaggaggaaaccatgcccgggcgctttgaactaaaaccaaccctggagaaagtctggcacgcgccggacaattttcgcttcatggacccgctgccgccgatgcatcgtcgggggatcattattgccgccattgtattggtggtcggatttctgcttccatctgatgatacgcccaacgcgccggtggtgacgcgtgaagcacagttagatattcagtcgcaatcacaaccaccgacagaagaacagctgcgggcgcaattagttacgccacaaaatgatcctgatcaggtggctccggtcgctccagaaccaatacaggaaggccagccagaagaacagccgcaaaccacccatacgcaaccattccagccagatagcggaattgataatcaatggcgctcctatcgtgtcgaacccggtaaaacgatggcgcagctgttccgcgaccacggactgcccgctaccgatgtctatgccatggcgcaggtagaaggcgcggataagccactgagtaatttgcaaaacgggcagatggtgaaaatccgccagaacgccagcggcgtggtgacgggcttaaccattgatacggggaataatcaacaggtcctgtttacccgccagccggatggcagttttattcgcgcgcggtagatgaagggtcaaccaaaagccagctaaggattgtctctttgatgaccttacgtctggcttccagtgcctggggtgaaaccatactgatgtgataaaccaggccaagcgtatgctggttgatcaaataatatcccccaagcgcagcaatattaatattcacctgcaatgggtcgatatctggcttaaaaatattttgtttcttcccttcatccaataaggattccattaactgcaagtgcgcatggttaatttctaaaagacgctgtgattttgcataatgcacacccttactttgattttcactatgcacaatttttaaaaaccagggattagaaatataataatcccatgtaaaatcgattattttctcaatggctttctgtggcggaagatctgagaaatcaagggccttttctttttgtcgaatatcgttccaggtatattccagtacttcgataaataaattttctttattaccaaagtggtgataaaccgtctgtttactgcaccccgcggccttgacgatattatcgactctggccccttcgtaaccatattcggcaaattcattaaccgcgcataacagcagcttttctttcaggctctgtacgttgctggtatcaagatacataacgcttccccacgacctcttcgtggtgactatcataacctgatttgatttcagcttcagaaaaaagggcaaaaacttgtactttcatcaggttatcaaatgtcctgtgatcgccatcgcatatcaaccaactagatggttgatctttttatcctccagtcgcaagctaatcatcactaaggaaacaaaattcaaaaaaagagagctattgtatgaaatccactcgtcctgttgccgtgattaccggagccgctcgtggtattggaaagggctgtgcgctggagcttgcgcgtggcggatttaatctgctgattaatgatcgtccggatgcggatagtgtagaaaaattacatgccacacaacaagaatgtctggcggaaggcgtggaagtgatttgcttccctgctgatgtgggcgatctctccctgcatgaagagatgctcgacgcagcgcaaaaccagtggggacgtctggactgcctgctcaacaacgcaggcatttcagtgaaaaaacgcggtgaccttctcgacctcgaaccagacagcttcgaccaaaatattgccattaacacccgcgcaccgttcttccttgctcaggcattcagtaagcgcttactggcacagccgaaaccggaagcagaactgccgcaccgctcgattatttttgtcagttccatcaacgccatcatgctggcgatgaatcgcggcgaatataccattgccaaaactgccgtctctgccgctgctcgtctgtttgctgctcgcctttgtaatgaacaaattggcgtatatgaagtgcgtcctggtctcatcaaaaccgatatgactattccggcaacggcctattacgacgaactgattgccaaaggtctggtgccgtggggacgttggggttatccggcggatattgcttccactgtccgcgcgatggcggaaggtaaacttatttacacctgtggtcaggcggtcgccattgacggtggcttaagtatgccgcgcttctgaggctgaatcatgagagatctgttacaacgcccggatttattcagtatcaataccgcgacactgggctataaaacgccgctacccgccattattgatgcctgcgccgcacgcggtattggcgcgattgccccctggcgcagggagttgcagagtgaagatctccagcaaatcgcccgccagcttgctgccagtaacatgaacgtttccggtttgtgccgtagcacctactacaccgcaccgacgctggcggagcgcaaactggcgattgacgataaccgccgggcgctggacgacgccgctgtactgaacgccgcctgttatatgcaggtggttggcggtctgccaatgggaacaaaagatctgtacgaagcacgggaacaggtgaaacaaaggattcgccagttgctgccacattcgaaagaggtcggcgtgccaattgcactggagccactgcacccgatgactgctgccgatcgttcttgtctgtgcacgttacgtcaggcgctggactggtgtgatgaactcgatcccgatggcgaatttggcctcggcgtggcggtagatgtctaccatgtctggtgggacccggatctcgccagtcagatcctgcgtgccggaaaacgcatcctcgcgtttcatgtttccgactggttagtgccgaccaccgatctggtcaatgaccgtggaatgccgggagatggtgtcatcaatattccgtcaattcgtcggctggttgaaaacgccggatttaatggcgctattgaactggaaatattctcaccgtactggtggcagaaagatattaacagcacgctggatattagcgtcgatcgcatcgcgcattattgttaaggaatgatcatgaatgaccaacccgttctgttcagcagagcggcggcttcttgccgcctgacattgaaccgtgaagataaatgtcatgctattaatgaagaaatgatcgaatctctcgaccattatttaaatgaaattgaaaacgacaccacattacgattagtcgaattaacggcaaccggcgataaattcttttgtgcgggcggcgatattaaatcgtggtcggcctattcgccattagatatgggcagaaaatggattaaacgcggtaacgaggtttttaatcgcctgcgcaacttaccccaattaaccgttgcgaatctcaacggtcataccatcggtggcggtattgaacttgccttgtgctgcgatattcgtatcgctcgccccggcgcgaaattctctaacccggaagtgatgctcggcatggtgcctggctggatgggcattgaacgcgtgcttaatcaggttggcccggtggtcggtcgccagatgctgatgctgggtaaacgcctgacggcgcaggaagctcaggtggcgaatttaattgatgaagtggtagaaaaagaacaggtggaaagctggatggcgaaccagttagcgcagctggaaaaatgtggtccggtggcactggcacatattaagcaactgattctggcgctggaaaataaacacgccgattactcccaccagttactggctggattaatgtccgccactcaggattgccaacaggcgacgcacgcatttgccgaaaaagccggcgtgagcttccacaatcaataaggaaattgtatgcgtaagttatcaaccgccgagacactggcggcgcaaattcaggacggcgcaaccattgccattagcggtaacggcggcggtatggtggaagctgaccatattatggccgccattgaagagcgtttcctgcaaaccggacacccgcgcgatctgacattaatccactcgctgggtattggcgatcgcgacagcaaaggcactaaccgttttgctcacgccgaaatgctcaaacgcattattgccggacattttacctggtcgcccaagatgcaggaactggtgaaaagcaatgctattgaagcctactgtttccctggtggcgtaattcaggcactgctgcgggagatcggtgccggacgtccggggctttttacccacgttgggctgggatcgtttgttgatccacgcaatggcggcggtaagtcgaatgaatgcacgaccgacgacctggtagaactgattgaaatcgacggtgagaccaaacttcgttatcgccctttcaaagtggactacgcgattttgcgcggcacctatgccgatccgcgtggcaacgtcagcctcgaagaagaggcgattgatatggatagctattcgatggcgctggcagcacacaacagcggcggcaaagtgttcgtacaggtccgcgatgtgctggaagcaggtaccatcgaaccacgtcgggtcaaactaccaggaattctggtcgatggcatcgttgagcaccgcgaacaaccgcaaacctatcttggcggttacgacctgaccatcagcggtcaacatcgccgtctaagttctaacgacgctattgaactggttagtcatccggtgcgtcgcctgattgcccgtcgggcagcgcgggaactggtggcaggcgcttcaaccaactttggctttggtattccgggcggtattcctggggttgcgctgcgcgaaggcgtgccttatcaaagtttgtggctgagtgtagaacagggtgtgcataacggcatgatgctggatgatgctctgttcggctgcgcccgtaacgccgatgccattattccatcactcgatcaattcgaattctacagtggcggcggtatcgatatcaccttcctcggcatgggagagatggatcggtacggtaacgtcaacgtatcccatctcaatggcaatctcattggccccggcggcttcctcgaaattgcgcaaaacgcccgtaaagtggtgttctgcggtacgtttgacgccaaaggcagcaagattgatgtaacgcctgatggcctgcatatcgcccagtcaggtcaaatccccaaactggttacccaggtggaaaaaattacttttagcgccgcatacgcacagcaaagcagtcaggaagtgctgtatatcaccgaacgtgcggtattccagttaacggcagaaggcgttgaattaattgagatcgcccctggcgtagagattgaccgcgacattctgccgtatatggccttccgtccgattatcaggcacccacgcctgatggaaagtagcctgtttacgccaatggaggatgcatgagtcagcttgatgaggccatccttgatgcactgacacacgttactttcccaaagggttttgcacaggcagaacccgcatgggttgtcacggtagacggtgttgattacccactctggaaaacagatgccctggtactcggcagtggtgcagccgggctacgtgcagctgtggaacttaaacgccgccagcaaaatgtgttaatcgccaccgccgggttatatatggggacgtcggcatgttctggctctgataaacaaacactgtttaccgccgctaccgcgggcaacggcgacaacttcgccaaactggcagaggcactggcgagcggtggggcgatggatcacgacaccgcttatgttgaagcggtaggttctctgcacactcttggcgggttgcaatatcttggtctggaattaccggaagatcgctatggcgcgattcttcgttatcaaaccgaccacgacgaagccgggcgtgcaacctcgtgtgggccgcgtacctcaaggttaatggtgaaagtgctgctggaagaagtacagcgtcttgctatcccaatgttgaccagtgcaacagtgattaaactgctacatcagcgtgacgaaaacggcgaagaccgcgtggcgggggcaatcctcgcgaccggtcatcgcgcccataacccatgggggctggcaattgtgactgcgcccaatgtggtactggcaacaggagggcctggcgagctttatcgcgacagtgtgtatccacacaaatgtttcggctcgctggggctggcgctggaggaaggtctgacgctaaccaatctgactgaaagccagtttggtatcggcacaccgcgcagcacgtttccgtggaatttgtccggcacctatgtacaggtgatcccatatatctattccgtggatgccgggggtaacgagtataacttcctcgcggattactatcgcaccacccaggagctggcttcaaacattttccgtaaaggctatcagtggccgttccacgccacgcgggtaatggattttggctccagcttgttagatatggcagtagcgcaagagcagcaacatggtcgtcaggtatttatggatttcaatcgtaatccagaacctgtgccgggtgacctgccgttctcattagatcgactggacgacgacgttcgcgcgtatctggaaaataacgacgctctggcaccatcgcccatcgaacgcctgcaacaaatgaatcctctgtctatctcgctgtataagatgcacggttacgatctcatcacgcagccattgcagtttgccatgaataatcagcacatgaatggcggcattgaagtcgatatctggggacaaacatctctgcccggttgttttgcggtgggggaagttgctggcacacacggcgtcacccgacctggcggcgcggcgttgaatgccgggcaggtttttgctgttcgtctggcgcgctttattggttgcacgcaaaagcggaatattgatggagatattgcacagctggcagctccggcactggcttctataagagagatcattactcaggcgcacgataacgggtccgggatgccgttgtcggttgtgagagaaaaaattcaggcacgaatgtctgactatgcgggatttatttgccatgccgataaagtccgacgtgccactcgtgatgccctgctattgaacgaatttgtgcaacggcatggattggcaatcaaacatgtgggtgaagttgccgagctgtttatgtggcggcatatggcgctgacttctgccgcggtattaacacaattaacgcattatattgatgctggtggtggtagccgtggggcgcgtatggttattgatccacaaggcaaatgcctaccacaaactcgtcgcggcgcaaaagaagaatggcgttttcgctctgaactcgctgaagacaaaaatcacaaattaacaattcaatattcgcaaggttcttttattaccgaagtaaagtctttacgtattcaaccgtgtattaacggtatttattttgaaaaaaactggccagactttttaaagggagacatttacacacaataattttcaatatttcctctgtacctgatttttattgcctattacatggaaataccaacaaccagggtttattaatataattaaaaggtttaaaaatgaataaaataaagaattatcgatggcatatgattgccctcgtatgctttatcactgtaatcaattatctggacagaacggcgttaggtattgcggctccaacgattatggagacaaccggaataaccaaagaacaatattcatggattgtcagtgcattccagttggcctatacattggggcaaccgataatgggcttctttattgataccgtgggtctgaagttaagttttgcgatatgtgccgcaatctggggcctggcgacaatggggcatgccttgacaggaacatggtcaggtctggcatttatgcgcgccctgatgggtttcagcgaagcatcggcaattcctgcgggtgtaaaaaccgcatcaacatggttcccggcaaaagagcgtggcgtggcgacaggtattttcaatatgggcacctcactcggcgcgatgcttgctccaccgttgattgcctggtgcattatgtttcatagctggcaatttgcgtttattgtctcaggtagccttgctttactcgcggctttattttggttcttttgttataaagatccaaaagatgctaaacgcctttctgatgaagagcgccactatattgagtctggacaagaacagcatcttaaaacagataagaaagaaaaaacgtcaatcaagcatatcctcagccaacgtaatttctgggggattggcatcgcgcgttttctcgctgacccggcatggggaaccattaacttctgggtaccgattttcttcgtcgaaacgctgcattttagcctgaaagaaattgccatgttcgtctggctgcctttcctgctgggcgatctcggctgtttagccagtggttttgtcgcgaagttcttccacgatcgcggcgtgagtttaattaactcacgaagaattaccttcactattgcagccgtcattatgatgacgattggtctggtgagtattgtcgaaaatccctacatcgccgtattactgattagcattggcgcattctcgcatcaatgtctttctactgttgcagcaactctgggcggtgacctattcaaaaaagacgaagtagctaccgctgtgggtatggcaggagcctgtgcatggagcggtcagttgattttcaacctgtttatcggggcattcgttcacattattggcttcgcgccgttctttattgccctggctttctttgacattattggcgccattgcgctgtggatgcttatcaaagttaaagacgaagaaccacaagtacagttagcgacaagctaattattttacatagaaacgctataatttagctttgtagcgtttctatttttctcataaattaaacgtctcttccaaaacgttcagtatctactggcattgcttcgcaaatttatgatttagcgaatatatcaaaataactattctaaattgcccccctgaacgcctctgccattaactcttgctcacgaccaggtaatcgaagacgctcggcaatgattcgccactgactgacaatccctctaaaattagcaataatgtcatctgcttctgtcaaaccaagtcgaaaatactccgcaacttctcgagctaattccaaatcaagtgcattatcattttctgtaatattgagttttagaccgtcagacctggcaacaggattcaaatcatatgcctcagaaagccgccaaccttttcccggtatcaagatatatccatgattacgtaaatggtcatcggtattagaaacaagaatattaaaaacaatcctggaccagagttccttaaggtcagtattagtctgcgctccatgtctgataagaacatctgctaattccagataactcacacctgtagaggcatcttcaccatcctgatgcctggttagtgtcatagccgaagcaaaatgcagacgccttcccgcattagtgcggtcaaaacgacgaaccataaaacaatggtaattgctggcaaatttatgcgcctgagcaggtgcaacattcagtccacagccaacagcaagtgcattaacgaccatttcccatccaccaacatcatactcatcttttacactgggaaatttagcgatgtagagatgcccagcttcatcaacaacactggttttcggacgtgcccccccctaatgatccccccggagcgattagcattcttaaccatttttgccccattagctctttattatcaggatcttcttcaattgcccggctagccctttccagactcgctatttcggtaaatggtggggctgcaacatcaatgcgattatcaagaaactctccagcgtcttcacgtttgtatcgaagagccccaacccgataaagatcatgaacacctagtagataatcagactcataaaggtgggagtctttatcacataacccgtctcgaatatccctctcaaaacgacgcttcattagcatacgcccccaacgatccgggcaggaatcactaaatgcaccaaatttatcctttggaggaattgggtactgtgctccctcatacaacattatttcaggatctaactgaatgaaattaagtgaaggatctgcaagcgcctttttatcgtactcaaactcaaatatctcacgcgtccgagtgcggcgactgtgtaaataaccaatccgctccggaccatccaggccttcccaatccgcatacactccgattaatgccataattaatttccttttaacggtttttttatcggttttaatagtgctgcaagagaggttgatgtttctcctgtaatagatggcgttgagccttctgccagtgctgttaaatccgtggtgagtaaaccttctttctcatacctcgtttgaaaagggtctgtctgaataccttcttcatttttacctgatgaacgagaaagccctctttttttaatcaaacgggaatcctggagctgacgccctaagtcgtcttcagctgcaagcttatttaaatccgtttccaggcccaaaacctgcatcacagacaaatatgcccctatcgtgacccctgcacttcctgactccagagagcgcaatgttattggcgacatcccagcacgttcagcaacttgctttgcggtaagcctgcgtcgtaaacgagcaagtttcagccgctcaccaaattcactaagcatctgattcgtataagggagtaacggtgctgtttttttacccatagtgataatattttatctttttatggctatgatagccataatattagcatttattggattgaacgcacctgcaaagcgttcaagattacgaaagtgatgatattttatccttttatatataaaaacaataaaataacagcgcattcatatataacatattgtttttattatcatacaagggagacgatcgctgtattgatgcttttgtcgtgttttacgcgtaaaaaacatgacacgaactaccagcggcgaggctgggggccaggtatgggtactgcgaactttttataaaaggaatagcaagagatttatggagggaacgtctatttctgcggtttttatcgcttaaaagcaaaacgccgaccactggtcggcgtttttacgtctcgttgaataacgaattattcagctactacgtttacgatcactttcgcgaatacttcgctgtgaacctggaagctcacttcgtgttcgccagtggtacgcagaacgccgttcggcagacgaacttcgctcttagccacttcaacgccagctgcagttacagcgtcagcgatgtcgcgagtaccgatggaaccgaacagtttaccttcgtcgccagctttagacgcgatggtaacagtttccagtgcattgattttctcagcgcgagcattagctgctgccagaacttcagccagtttagcttccagttcagcgcgacgtgcttcgaagaattcaatgtttttcttggtagctggaacagctttaccctgcggtaccaggaagttacgagcatagcccgctttaacgtttacctgatcacccaggctacccaggtttgctactttatcaagcagaataacttgcattaccttatcctctcaaagtcgtattaatggaccgtgaccgattactgatggcgatcagtgtacggcagcagggacaggtagcgagcgcgtttgatagcgcgagccagctgacgctggtattttgcacgggtaccggtgatacggcttgggacaatcttaccgctttcggtgatgtagtttttcagcgtagcgatatctttatagtcgatctcttgaacgccttccgcggtgaaacggcagaacttgcgacgacggaaataacgtgccatatggctagtctccagaatctatcaattcaatctgctcggcatgcaaaaccattttgctcagtccgttctttgccttatggcatgaaatgaacccctgaacggttatgcgactgccgaccgttatactgtgagtaatggcctggttttcgtgtccgctaacaataacgggcatttggcaccacgcctgccggtgaaagccggcttcctcctgcacagaacgatgctcaagcacgaactggcagtgaggaattcctgatggactgacctttcgaaggggagtcctgcacacggtgccggacaacaccagacggttggtcatcagaaattactcttcagaatccccagcttcagcatcatcagcggtttcgtttgcgaaatcatcgcgacgctcacggcgctcgtctttcgctttaaccatcggagatgcttcggtaacagcgtgcttggtacgcataaccatgctgcggataacggcatcgttgaagcggaaggtagtttccagctcatcgatcacttcctgcggagcttcaacgttcatcagaacgtagtgtgctttgtgcagtttgttgatcgggtaagccagctgacggcggccccagtcttccagacggtggatcttgccttctgcaccagtgatggcagcagtgtagcgctcgatcatgcccggaacctgttcgctctggtcaggatggaccataaaaacgatttcgtaatgacgcatcgaattgctccttacggattattcagcctcctgtctgggtcagccgaatcccggggaggcaaggaacgtgttaaaggtcggctgaaaaatgacgcgttataatactgacataccccgctaaactcaagggctgagcagaaataaatcgcccctttcgcaaataacctctaaaccgctgatttggagttcatcacacttcgtcatggtgtttttttgaacaactgcatcagaaatggtcaccatcaacttctttatcattgattaaaattaaatcagaagatcaccacaagaggagagcacacaaagtcagccgtcaaggaggtatctatgttcagtcgtgttttagcccttctggctgtgcttttgctaagtgcaaatacatgggcagccattgaaattaataaccaccaggccagaaatatggacgatgtgcaaagcttaggcgtgatttatatcaatcataacttcgccactgagagtgaagcacgtcaggcattaaatgaagagacagatgcgcaaggcgcaacgtactaccacgtaattctgatgcgggaaccggggagtaacggcaatatgcacgccagcgcggatatttatcgctagcaccaggtataaccaacgaaacattgccatagtttgctttgcccccttcgcagggggcttttttttgaaaaacggctgcggaattagaccagttatctcccgaagaaggaaatttccgcagcgcgtgttttacttctgcccgtaataagcgttaggaccgtgcttacgcatgaagtgtttattcatcagaaagctgtcgatgtgattcagttgtgggttaatactgcgcgcaatccacgccattttcgccacttcttccatcaccaccgcgttatgcaccgcatcgtgggcatctttcccccaggcgaacggtccgtgctgatacaccacaattcccggcgtatgcagcggctcggcgtcacccagcgtttcgataatcactttgccagtgtttagctcgtattcgccctgcacttcttcttcacttaacccacgcgtacacgggatatcgccaaagaagtaatcggcgtgcgtggtgcctaacgccgggatcgccagccccgcctgcgcccatgcggtggcatgagtggagtgggtatggacaataccaccaagcgacggataacgacggtagagttcgagatgcgtcgcagtgtcggaagacggacgatactccccttccaccacgttgccgctcatatcgaccactaccatatcgtccgctttcatggtttcgtaggcgacaccgctgggcttgatcaccaccagcccgcgttcacggtcaatagcgctgacgttgccccaggtaaaggtcaccaacccgtaatgcggtaaatccatgttggcttcaaacacctgctgtttcagcttttgcattatgccgcctccaccatgcctgctttggccatgcgcgctttcacccaatcacgcgctttcgctacttctgccgccgggtcttccgccgtttcgctccacatctcaatcaggtacggcccgcaatagccactctgtttgagcgtttcgaagcaacgttcgaaatccactacgccttcgccaaacggcacgtttttgaagacgcctggtttggtgtctttcacatgcaccgcgacgatgtgcccgattccagcctgcaactccatctgcacgtcattatcccacgccgacaggttgccgatatccgggtagagctggaaccacggattgttgagatagtgtgcgtagcccagcgccttgctgatggagttcatcaatgggtaatccatgatctccatcgccagcgtgacctgcgcacggcttgccatctcaacgctctctttcaggccgtcacggaaacgacgacgcgtttcgttattggcttcctgatagtaaacgtcatagcccgccagttggatcacgcgaatgccgacgtcctgggcgaactggatagctttacgcataatctccagcccctgcgcccgcaccgcgtcatcttcgctgcccagcgggaaacgacgatgagcagaaaggcacatagacggcacgcgcacgccggtttcaacaatcgcgttcaccagcgccagacgctgctcgcggctccagtcgaggcgcgaaaggcgatcgtccgtttcatctaccgacatctcgacaaaatcgaagcctaacgtttttgccagttgcagtcgttccagccagcactccccagcggggagtgctttttcgtagatgccaagcgggatttgtttggacaacatatccgctccttagccccacagttcagcgatggaacgtttgaactgacgtgcggcctccaccggagaagcggcatcacgaatgctgcgaccagcgataaacacatgaatcggaatgcctttaaacaacggcagatcttccagcgccagaccaccagtgacggtaactttgaagcccatatcggaaagacgtttgatcgcggtgatatccgcttcgccccatgccacgcctgcggcctgcgcgtcacggctgcggtgataaaccacctgcccaatgcctgcgtcgcgccactgctgcgcctgttcccaggtccagtagccggtcaattcgatctgcacgtcgccattaaactcttttgccacgtccagcgcgcctttggcggtgttgatatccgcacagcaaattacggtcacccagtcagcgttggcttcgaagcacatgcgagaaaggattttgcctgcatcggcaattttggcgtcagccagtacgattttgtgcgggtacagcgctttcaggtcacgaaccgcacgcacgccttcgcctacgcaaagaatggtgcccacttcgataatgtcgacttcttcggcaatcaggcgagtggtttcgtaggcgctatccatagtctggttgtccagcgcgacttgcaacatcggtaatgacatgttcaattccttcttaagctgccgcgttggtgcggtcaatgagatccagtacttcctgctcggtacggcaggcacgtaaacggtcgaaattggcttcatcttcaaacaggttgacgatctgcatgatgcccacttcctggtgagtgttggcatcaaccgccgccatggtgatgaggatatccaccggatcgttatcttcgtggttgaactccagcggctttttcagcgtcaccagcgcaaaaccagttttcttaaccccctcttccgggcgtccatgcggcattgccaggccgggtgcgagcacaaagtacgggccgtgctgttcaaccgcatccagaatcgcctggtagtaacgcggctctaccacatctgccgctaccagcagatcaacgccgattttcactgcgtcctgccatgtctctgcttccgcttgcaagcggatagatttattttcagccagcgaatcacgtaatttcatggcgcgtccttacttcacgtcctgcgggaaatgctctttgatcacttccagcagtttcgggccaaaatcagcaggagagagcatgttgcgcacgccaaccacatatttgttgccggtcacggtgatttcgcccgcaatatgggtagaagcgatgatgatatccgcaccgctcaactcgcttttgtattcgccaaccgcgcagctgtttaccgtgtggtcgatgttcgactgggttaaaaactggtccactttcattttcatgatcatggaactgccttgtccgttaccacacacagccagaatacgtacggtcataatcaaaactccttattaagcagattgttctgccagttgtttttctgcatcttcttctgcacgcagtgcgcggccagcgaagaacatataagccagtgcaatgacaatgatgacggccataaaggcgataccgatggagaagaagccctgcatcatcggcggtgccagaatcgaccagtccgccatgcccatccaggcgctcataccggtgagtttcaccgcccagacgcaaccaaagatttcgatcatccccatcaccagacaaattttcagcgccgcgcgccagccgccgaagtggttagcgaacacgccgatagtggcgttggagaagaacatcgggataaagcctggaataatcaggattgaagagccacaggcgaccaggatgccaaccgcaatcagttgcccgatggtgccccacataaaaccccagaccacggcgttcggcgcgaagctataaatagccgcacagtcaatcgccagaaccgcacccgggatcaggcgctgggagataccgttgaatgcttcagagagttccgccacaaacatgcgcacgccctgagtgatgatgaaaatcgccaccgcgaaggagaaaccggtttgcaggatgtacaccgtccagttaactttgcctgccatcgcctgcacggtgtcgataccaaaggagagcagaatggcaccaaagaatatagtcatgacaatcgccgtggagacgatgttgtcgtggaaaatattcagccagccaggcagtttgaggtcttcaacgctttcctcttttttgccgaggaacggtgcgactttataagcaatccatgatgcgaactgctgctggtgaccaatggagaaaccacagccgtcggtgacttcctgtgtcggcttgtacatcatgttggaggtaatgccccagtagagcgaaaccagaatcgcggtgcagataatggtcgtccacatggagtagccgaagataaacagcgtaacggcaatcagccccgcctgctggaacatgatgtgaccagtcagcatgatggtacgaataccggtaatgcgacgcagcagcacgtaacagatgttcagcgccagcgctaacaacaccgcgtaacccacccagctataggcatcgcccatgcgttcaatggttgccatcatcgacgcgtaagtatcggaaattgcgccgttaatgccgtagacttcggacattttcgccaccaccggtttgaaggtgctggtcaggatgccggaccctgcctgcaacaacatgaaaccaattatggttttaatcgtacctttaataataacgctgacacttttgcgcagtaggatgtaacccagacaggtcacaatacccagcaacaacggggcattggtcatgacctggttaaaaaacacggtaaagatgttgtagaggatctccataacgatctcctgaagaagaggtaaccgggtatttcgcacacccggaatgttgtgctctcactctaattttcaaaagtaatcacaacaagattatttatgattaaatgtgacgtcgcacgcaaataattccatataaacagaatgggattcacataatgaaatatttattcatttaaattcatttagttaattgcattacacattcaatttaatctttccacactcaaaatccacaataactctcctgctaaaaagtcaaaaaatggtcattgccttcctgaaaaaatagtgtcaggattaatcaaaaccaatcacatattgattcgaattgaactatcacgaaggtaaatggcgatgagtaaagtgaaaagtatcacccgtgagtcctggatcctgagcactttcccggagtggggtagctggctgaatgaagaaattgagcaagagcaggtcgcacctggcactttcgcaatgtggtggctcggctgtaccgggatctggttgaaatcagaaggcggtgccaacgtttgtgttgatttttggtgcggtactggcaaacaaagccacggtaacccgttcatgaaacagggtcaccagatgcagcgcatggctggcgtgaaaaaactgcagccaaacctgcgcaccaccccgtttgttcttgatccgtttgcgattcgccagatcgacgcggtactggcgactcacgatcacaacgatcatatcgacgttaacgtcgctgctgccgtgatgcagaactgtgctgatgacgtaccgttcattggaccgaaaacctgcgttgatttgtggattggctggggcgtaccgaaagagcgttgcatcgtcgttaaacctggcgacgtagtgaaggtaaaagacattgaaattcatgcacttgatgctttcgaccgcacggcactgatcaccctgccagccgatcaaaaagcggctggcgtactgccggacggcatggacgatcgcgcggtaaactatctgttcaaaaccccaggcggtaccctgtatcacagcggcgactcccactactctaactactatgcaaaacatggtaatgagcatcagatcgacgtggctttaggttcatacggcgaaaacccacgcggtattaccgacaaaatgaccagtgctgatatcctgcgtatgggcgaagcgctgaatgcgaaagtagtgatcccgttccaccacgatatctggtcaaacttccaggccgatccgcaagagatccgcgtgctgtgggagatgaaaaaagatcgcctgaagtatggcttcaagccgtttatctggcaggtcggcggcaaatttacctggccgctggataaagacaacttcgagtaccactatccgcgtggtttcgatgattgcttcactattgaaccagatctgccgttcaagtcgttcctgtaatctgtcgcttgtaccggatagcatggagatgctcgcgctatccggcatagtatttcctggctatttcaaatatcatctaaaaaaatcaaattttatcggaatagctcatgactgaagcacaaagacatcaaatcctcctggaaatgctcgcacaattgggctttgtgaccgttgagaaagtcgttgagcgtctgggaatttcgcctgccactgcacgacgcgatatcaataaacttgacgaaagcggcaaactgaaaaaagtgcgcaatggcgcagaagctattacccaacagcgcccgcgctggacgccgatgaatctgcatcaggcgcagaatcacgatgaaaaagtacgtattgctaaagcggcctcgcagctggttaatccgggcgaaagcgtagtcatcaactgcggctccaccgcgtttctgcttgggcgggaaatgtgtggcaagccagtgcaaatcatcactaattatctaccgctggcaaattacctgatcgatcaggagcatgacagcgtgatcattatgggcggacagtacaacaaaagtcagtccatcactttaagcccgcaaggcagcgaaaacagtctctatgccgggcactggatgtttaccagcggcaaaggactgacagcagaagggttgtataaaaccgatatgctgacggcaatggcagagcagaagatgctgagcgtggtagggaaactggtggtactggttgatagcagtaagattggcgaacgcgcgggaatgctttttagccgtgccgatcaaatcgatatgctgatcaccggcaaaaatgctaacccggaaatcctgcaacaactggaagcgcaaggggtcagcattctgcgtgtttaaagatgctggcggaaaaatgtcacggcagcatctaacgcctcaggcgtaatgcggtgacgcacgcctggctgccatgaacaggttagcagtttatcccgccccgtctcgcttaaggcctgctgcaaacgtagtgattcgtcggcaggcacgacgtcatcgtcaaggccatgccacagcagtagaggtctgtcaccaagttgttccaggtggtttgtcgcttcccactctgccagcggcgcgacaatgttattgaattcattctgctgtgctgccgtttcaggtatcagcggtggaaacagtgaacgggcgagcgatgtaaaatagcccgatcccatcatgctggcggtacattttatcgtggggtggcgagcggtaattcccagtgccgtcatcgcgcccatcgacgcgccaccgactgccagacggtcatcacgcagccagttttcttcggctattgccgcacgtaaggtagtgaattcctgcatactttgtagcaagatttgccagaattgatttaaccgccgcgctgcgtcgccactaaaacggctaccgtgatcgggcgcatccggcatgatcacccgcaaaccagcctgcgccagcgcaacggcaaaatagctatacaccagactggacgaagtaaagccgtgataaaaaatcacacacggtaacggggtatctttttgcccgacaggataagcatgaagaacgggaatatctggcagctcgcgtgattctatttcaatcatctgtctctcctttttgtctggtatgacatgaagaaatccttagcacaagtttctgctggcggtattagttcataatgttgagatgtgggttacgctttcgtcacgttttcattcgaaaatcgcgtaccaggtaacaattcgggaacattcccccaaagttaaattaataaggcactacactatggttagcaggaaacgtaatagcgttatttaccggtttgccagtttattattggtgttgatgttaagtgcctgtagcgcactgcaaggtacgccacagccagcaccgccagtaacggaccatccgcaagagattcgccgcgaccagacgcaagggttacagcgaataggtagcgtaagcacgatggttcggggttctccggatgacgcattagcagaaatcagagcgaaagctgtcgctgcaaaagctgattattacgttgtcgtcatggtggacgaaaccatcgtgacaggacagtggtattcacaagccattttgtaccgtaaataaatcagacaacttacatagtcagctttacattgctttgcgtccctatgcgtttacctgtgcacaataaattaccggctggaagctcgggcgtttattaccgcgatggaatgccctgcaacatgtggggaaacgaaaaatggagctgacgatgaaacaattacttgcctcaccctcgctgcaattagtgacttatcctgcgagcgccacggcacagtctgcagaattcgccagtgctgactgcgtgacgggcctgaatgaaataggtcagatctcagttagcaatatttcaggggatccgcaggacgtggaacgtatcgtggcgttaaaggccgatgaacaaggtgcgtcatggtaccgcattattaccatgtacgaagaccagcagcctgataactggcgcgtacaggcgatactgtatgcgtgagtgtcatctacagcaaatgaacaatgccggatgcggcgcgagcgccttgtccggcctacaattttaaaatatttcatttagttaatcgaaaccagcgtcgcatcagtcgtatacgcttacaaacacactcctcccgtcgcccgcagcaataaatcattctggatctgctctgacaaccgtacgccgccgcgcgtatctaacatcaccttacaccacgcctgcgccattggcggagaggcatatttcaacatttgcgcaccgcagcccagcaggaatagctgatgagtaatctctcgccccaattcttcagctggcttacgcagctgctgctgtaaacgacgaaccgcgcgatcaaaatagcgatcctgccctttcacttccacaaatgcttccgacaataagtcgtatacgcccgcttgcttattgagaacgcgcagcacatccaggcacataatattgccggaaccttcccaaatactgtttaccggcatctcccggtaaagccgcggcagctcgctctcctcgcaataaccaatgccgcccagcacctccatcgcttcggccacaaacggaatgccacgtttgcagatcacaaatttcgccgcaggcgtaaataaacgcgcccacagagcttctttggcatcggcgcgccggtcccacgctcgcgcaagacgaaacagcaacgccgtttgcccttcaagctgaagtgccatgcgacttaagacatgacgcataaggggctgttggatcaatggattaccaaaaacatggcgttgatgtgcatggtaaatcgccagcgaaaatgcacggcgcatcatggcatggctacccagggcgcaatcaaaacgcgtcatcccacccattttcaggatcagacgaactccttccccttcctgccccaacaaccagccaatggcatcctgaaactccacttcgcagctggcgttagagcgattacccagcttatctttcagccgctcgaggcgaatcgcgttgcgttgcccgtcaggcaaaaagcgcggcacaaaaaagcaggacaaaccgcccgcggtctgtgccagcaccagatgcgcatcgctttgcggcaccgagaaaaaccatttatgccccaccagccgataagaaccatcgtccagacgctctgcgcgggtggtgttgctcatgacatcggaaccgccctgcttttccgtcattcccatgccgatcaacaagccacgtttttgcccacccggcaataagtgagaatcgtagcgatcgctcaacagcggcgtgatccagtcctgaaacggcgcgggtaacatctgtaacaacaatggcgtggcggcaaaggtcatcgttatcggacataacgacccagcctcaacctgcgcatgtaacataaaacgcgccgcgcgcgccacaaatgcgccggagcgagcgtcttcttcccaggcaagattgtgcacccgattggtacatagcgcctgcatcagcaggtgccaggcggggtgaaaacgcacatcgtccagacggcgtccttgcgcatcgtagcgcaataattcaggcggattcacattcgccagccgccccagctcaagggattcagccgttcctaactgctgaccaatactggcgagaaaatcgctatcccagccagcaccttcatgcgttaccgcttcgcaaagcgcgccatcagacaggtataagttgctgttatttaatggtataggttgattaaaaacggtgtgagtttgccagtgcactgtgtctccctccatcaatggcagtcaccattagtatggtcactgccatggattcatgacagaaagagattgctaaaacattcttatccagcaatgtaatgcggaacgaaacgtgaggtgtctttggtgatcaacgtgttatcttcacggatccccattccgcacgcttcatcatcgacaatccagctaccgatgagtgtgtagctatcgccaaatcgcggcagaggttgaaacgcctggtagatcatcggttcatcggcgtaatcaccatcagcgtggtcaacgacgttattctgaccgtcgaaaatggtgacgtttccgccttcgcgcgagtaaatcggtttacgcacatagctttcgccagcggcaatctgcggtttttcaccatcgaaccaggatgcaagaaggttaggatgaccagggaagaagcgccaaagcagcggcattagccctttattactcaagatacttttccataacggctccacccattgctcgcgacgcttgcgcagcagcggaccgttatcgtcacgcatcatccactccagcggatacagcttaaatgcacgctggatgacattatcatcaagatcggtcagtacgccgccgacgcccaaaccgagctcttcaatgtagataaaccgagactcctgccctgcctgctcggcgcagtcctgcaagtacagcacggtactcctgtcttcgtcggtatcctgacagcagcaaaaataaaacggttcccgactgtaaagctcgctaaaacgcgaaatcaggcgttcctgaatggcattgtactgatcggcatcacgcggaataatgccgccacgccgggcgtcttccagccacaaccactggaaataagccgactcatacaacgaggtcggtgtatcagcgttgtactccagcagcttaaccggtgcattaccacaccaggcaaaatccatacggccatacaacgaaggatcgcgtgcgcgccagctttcggcgatcacatcccagtacaacggcgggatcgccagttgcgtcaggatctcttcatctttaaccgcgcgatccaccacctcaaggcacatctgatgcagttccgcagtcggtttttcgatctgctcttcaatctgacgcagagtaaagcggtaagcccgactctcatcccaatagatttcattgtcgatgatatgaaagtcaaatccgttatcggcggcaatccggtccagatcccgccgcacagtaacgttgtgtctcagcatgattagcctccccaatgcccacgggcgctggaagaacgaccatagccgccgcgagaaacggttgacgcttttttggtggtaaagccgcccgaagagtaagactcttttttgccagaaccggagcgccaggagtaatcaccggaagtgttgcgccagacggggcgggaagcaaatgaggatccgccgctgttatagacgaacggctcatcgcgatctttacgaataacccggcttaacaaaaatccagaaacgaccgggatccaactctgttcaacattgtcgtagtagcaattttcgtacttagactgacaattctgctgagtcatattcttcggaacatcggcataaaatgccgctttggcgttgttccagccatgagcacagatatctgaattattaccatcatcaatacaatcctgcacagtcgcgtaaaacgttccgtcgccgtcgttatcgacatcgccactatcgccacaacctttcaatacgaaaaaagcggcaccgcccattagtgccaacgttaagtatttttgtgcgtagcgattgcggcgcggctcaaaaggattatgcggtctaccaatgcgactgattgccccatgtccgatatttttgttatttctggatttgcgttttctggccatgatcgtccattaccatgtcatacaagctgcgttaaaaataccgccagccagcgcggcggttcccataaacattcctgctgcggtattgtgattaataattttttcgcttaatgcaggcatataaagcctgacgccagcaaaaacgagtaattgaatcaccagagcaatcccgccccatgcgaaatagtctggaatactcaccgcattgattgccgcactggataaggggatcacgtcccccaacaatgttccgctgaacgccagtgccgccgcggtgttattgtttttgattaactgccattcgttgtgcggtgtaattttggagtagataaacaggaaaataatcaccatcgccacgccaataaaaaaataggcactaaaggcaagaagtgaatccagtatatgcattgtaaacgtccttgtaattaaccaataatatgaagtgatgtcatcgggatatcgacacccagcgcgcgcgaaaataaccactccggctcgccgagatcgttaaaagattcctcaccatttaacagcaaatattcgtaagtatcttcggtcacctgccgttggtagcccatgctaaaattatgcacttcccatttggcatggttttgattttctactttttccagcatgtagacgggttcgatatttcccggttcttcgctgttaaaaaatcgctgccagcgtttttcctgccagtttaaggtcattgcccccatcgctttggcgttgatcgcctcgcgccagtgactctctttactgataccgtagctctcttcatagacaaagagcttgatatcatcaatgtcatcaatatcttcgccgccagtggtattgatttgcaggaactcatcgcccgaagtgtagtaacggaaaatctggctacccccgcccagatcgatgcaactgacggcggccacggtatattcttcacccggtagctcgatcagcaatgcatcttccagcaaacgaaacgctaacgtatcgagcgtaaaaccactattgagatgcagacccaacggaccgcgagcgatagcaggcttattatccttgccaaacagacgctggaaaaaaccagacatattttatccttaaaatagttgccagccttgcagtgaggctggcaaaaaattactcgccctgttggcgttgcagtcttgctaatacatcctgggcgctacttttattgctaccgccaattccggcttccgccagcttttcatcgagatcgcgaccgtctgcgactttttccaactgtgcggcagcatccaggcgagcctgacgttcggcctgacgcgtttgcaggcgttttaaggattctgccgctgtcgaaacgctggaagatgcgccaacagtagaggtcgttacagcctgttgtgcacgctgcatggcttcagtggctttaacgacttccatttgctgctcaaactgagcgatacgctgcgctgtcgctgtaactgctttttccacgccatcacgagagacttccagattcgacaacacttgctcttcagcggtaatgagattctcaaggcgcgcgatttcttcagcaacttcgttaatcaacgacggattcacgttcttgcttaacgcttccagcgcacgagcttccagactggctttacgctcacgtaaatctttcagcttatcgtgacttaatttcactcgcgccagcagatcaacgcgagattttccggctttatcgagttcagtttttgcgtcacgaatatgctgttccagcatgcgcacgccctggttttcttcaatggactcttccgcctgggagataaacgatttccccagcgtaaataaactttttaaaatccccataaatacccgtccttgtaattagtgtgaatattcttctgtaatttcagccagatccaatgcgttatctaccagcgaagttatctcaagcaggatatcttcaagagaagatttaagcgataacgcaccgaaaacaatgtaatactcttcctgttgcacgctggagatccctaccgatgacaacggcatcatcttctgatttcttaataagaaggtattaaattcatctggattgctgatactacttaccgaacaaataaaggtttcgatgatcatttggcgggaagtaaaaagaatattgatttgcaaatcgccataatcattcattttaataattaatgcgctttcgctatttgttacatcaatattttgttcaggtacagtttgcagcgccgtcgccagcgccaacggattccatgtcatatattattccatatagattaagtttaaatattaataaaatgaatatttgcagtacgtaattatcttaccagctatagacaaaaaaaaaccatccaaatctggatggcttttcataattcagaggaactagctgcgctgacgaaccgcttcaaataagcaaattccggttgcaaccgaaacgttcagggaagaaacacttcctgccattgggatgctgatcaactcatcgcaatgttcacgggtcaggcgacgcataccttcaccttccgcgcccatcaccagcgccaggcgtccggtcattttgctctgatagagtgtatgatccgcctcgcctgccgtaccgacgatccagatattctcttcctgcaacatacgcatggtgcgcgccagattagtcacccgaatcagcggaacgctttctgccgcaccacaggccacttttttcgccgtggcgttgagctgtgcggagcgatctttcggcacaatcaccgcatgaacaccagcggcgtccgcgctacgcagacacgcgccgaggttgtgcggatcggttacgccgtcgaggatcagcaggaacggttgatcgagcgaagcgatcagatccggcagatcgttttcctgatactgccgtcctggcttcacacgagcgataatgccctgatgcacggcaccgtcgcttttctcatcgagatattggcggtttgccaactggataaccacgccctgagactcaagggcgtgaatcagcggtaacagacgtttatcttcacggccttttaaaataaagacttcctgaaaacgttcaggggcgcgctccagcagggcctgcactgcatggatgccgtaaatcatttcgctcattaatgtactcgttgtttacgttttgccgggagcgccacgcttgcccggcctacggataattcaccctcttctgtttgaagagggtaatgatcactctgccacttttttcttcgccgcacgcttcgctttggtcgctgcggctattttctgcgttttcaccgatggctttttcgcttttctcgcgtctttcttcgctgctttcggcttcggttttttctcgccgcgaaaggcgctgtctggctcaaagttgacctttttgccgacctgacgccgcttgccgccttttttgcctgcatcgccttttttcgctttctcgcgcgccgttttaccgacgttgcgcggtgcgcgttcgctggagatcaggctaaagtcgattttgcgctcgtccatattaaccgcttcaacgcgaacttccacgcgatcgcccaggcgataagtctggccgctggattcacccatcaggcgttgccctacctgatcaaagcgatagtagtcattgtccagcgaagagacatggaccagaccatcaatgaacaagtcgtccagacggacgaagaagccaaagccagtgacgctggaaattacgcctttaaagacgttacctacctggtcgagcatgaagtcacacttcagccagtcagacacatcgcgcgttgcttcatcggcacgacgttccgccatcgaacagtgctgacccagttgcagcatctcttccatcgaataatggtagccgccggtttcagtggtgttgccctgatgcccctgctctttcgccagcagatatttaatggcgcggtgcaacgtcaggtcaggataacgacgaatcggcgaagtaaagtgcgcataggactgcaatgccagaccgaagtgaccacggttttccggatcgtaaatcgcctgtttcatcgagcgcaaaagcatggtttgcagcatttctgcatcaggacgatcggcaaccgattccagtaactctgcatagtcgcgcggttccggcttgttaccgcccggcagttccagccccagctccgccagcactgaacggaaagaggtaatcgcttcggtgctcggcttgtcgtgaatacggaacagtgccggttctttggctttctcaacgaaacgcgccgccgagatattcgccagaatcatgcactcttcaattaacttgtgggcgtcgttacgctgagtctgttcgatacgttcaatacggcgttcagcgttgaaaatgaacttcgcttcttcgctctcaaatgagatcccaccgcgttcttcacgggctttatccagcactttatagaggttatgtaactcttcgagatgcttaaccagcggcgcatactgctcgcgcagatcctgatcgccttgcagtatatgccagactttggtgtaggtcagacgcgcgtgagaactcatcaccgcttcgtagaatttgtagccagtcaggcggcctttcgacgaaaccgtcatctcgcacaccatacacaggcggtctacctgcgggttgagcgagcacaggccgttagagagcacttccggcagcatcgggataacctgcgaagggaagtacaccgacgtaccacgattacgcgcttctctgtccagcggcgttggcggacgcacatagtagctgacgtcggcaatcgcgacccataaacgccagccgccgccgcgttttttctcacagtaaactgcatcgtcaaagtcacgggcgtcttcgccatcaatggtgaccagcggtaaatcgcgcagatcgacacggcccacttttgcttcttccggcacttcttctttcagcccggcaacctgttgctcaacagcctgcggccagatgtacggaatttcatgggtacgcagagcgatatcaaccgccatgccggtgcccatattgtcgcccagcacttcgacgattttacccaccgctttggtacggcgagtcgggcgttgagtcagttcaaccaccaccacaaagcccatccgcgcgcccatgatctgatcgggcgggattaagatatcgaagctcagacggctatcgtcaggaaccacaaagccgacgcccgcttcggtgaagtagcgaccaacaatctggctggtttttggcaccagtacgcggacaatacgcgcttcacgacgacctttacggtcagcgcccagcggctgagccagcacctgatcgccatgaatgcaggttttcatctgctcgctggagagatacaaatcatctttacgcccttcaactcgcagaaagccgtagccatcacggtggccaataacggtacctttcaccaggtcgaggcgttccggcagcgcatagcactgacggcgagtgaagaccagttgaccatcgcgctccatcgcgcgcaggcggcgacgcaggccttcaagctgctcttcgccttcaatgtgcagttctaccgccagctcatcacggctggccggtttttcacgtttggttaaatgttcgaggataaattcccgactagggatgggattcgcgtatttttcagcttcgcgttcctggaaaggatcttgtgacatctcggttcctccgttgtcatctctgatgaagattttcgtcactccaccagcaataatttataaagcggttgattctcttcaaccaaatcggcaagcgtgtagttatccagttccgtaagaaaactttgcacggccttagaaagcgcctgtttcaaccgacaggcaggtgtaatgtggcaaaactcactgctgcaattcaccagcgataagggctccagctcgcgcaccacatcaccaatacgtattgcactcgccggtttacccaagcgaatgccgccattttttccacgaacagcagtcacgtagccggcacgactaagttgattgattattttgaccatatgattacgggagacgccgtagacgtcagtcacttcagaaatactggtcatccgcccttctggcaatgacgccatgtagatcagcgcacgtaatccgtaatcagtgaaactcgttaactgcacatcaacctcaaaagggaaatcggggaaaaatacatttatattgatgataaaccagccacaagctgtgtcgctaatttatttcagttcggggaaggaaaaaagcgaggatttaacactgtgtcggatagcgtaatggcttaaccgacacagcaatgtatcacactgttagcccggcaggcaaaatatctgccaggcgtaccagaattacgcgtcgaacgggtcgcgcagaatcatggtttcagtacgatccggaccggtagagatgatatcgatcggcacaccggtcagctcttcaatgcgcttgatgtagttcagtgccgcctgcggcaggccgctacgatctttcacgccgaaggtggattcagaccagcccggcatggtttcgtaaatcggctctacacctttccagtcgtcagctgccagcggagtggtagtcacttcacgaccatccggcatacggtaagccacgcagagtttaacctctttcaggccatccagaacgtccagtttagtcaggcagaagccagacagagagttcagctgtaccgcacgacgaacggcaacggtgtccagccagccggtacgacgacgacgacccgtagttgcgccgaattcgttaccctgcttgcagaggaactcgccagtttcatcaaacagttcggtcgggaacggacctgcacccacacgagtggagtaagctttgaggatacccagaacgtaatcaacataacgcgggcccaggccggaaccggtcgccacgccaccagcagtggtgttggaagaagttacgtacggataagtgccgtggtcgatatccagcagcgtaccctgcgcaccttcaaacatgacgaaatcgccacgctgacgcgcctggtcgagcagatcagaaacgtcaacaaccatagaagtcaggatgtcggcaacagccatcgtatcatccagaactttctggtaatcaaccgcttcagctttgtagtagttaaccaactggaagttgtgatattccatcacttctttcagtttttcagcgaaggtttctttgtcgaaaaggtcgccaacacgcagaccgcgacgtgccactttatcttcataagcaggcccgataccacgaccggtggtgccgatcgctttcgcgccacgcgctttctcacgcgcgttatccagcgcaacgtgataatcaaggatcagcggacatgcttcggacagcagcagacgctcacgaacggggatgccacggtcttccagttctttcatctctttcatcagcgcagccggagacagcacaacaccgttaccgatgatgctggttacattctcgcggagaatacctgatggaataagatggagaacggttttttcaccgttgattacgagagtatggcctgcgttgtgaccgccctggtagcgtacaacatatttagcccgttcagtcagaagatcgacgatcttacctttaccttcgtcaccccattgggtgcccagtacgacgacgttgttacccatttttcaaaatcaccgtttgcttaaaaatggattctaccatcgctttttcagagttacagcactttttgcactcaaaaatgacctcgatcagtctgttttttgttcagccaatcgttttcctcaacatgtagtagaccacaacgcccgcaaccacaagtccaccgccaaaacgacgtaaaatattatcgggcaaattggtcatcgcagagatcatcttcttccatgccttcgggtaaaacatcggccctaaaccttccagtaccaaaaccagggcaagcgccagccagattgtcgaattcattcattatccttatagaaaaagaaaaccaccgacatccctgaggatgtggtggctttattgacctgtaccgcagtcgttatattaacgcgttgcggaagtcggcgtcttcatgtagcggaagaaatcgctgtccgggctcatgaccatcacgtcctgattgccagagaagctgttctcataagcacgcaggctacggatgaatgcgtagaagtccggatctttactgaatgcatcagcaaacagtttggctgcttctgcatcgccttcaccacgcatgatgcggccctgacgctcagcttctgccagcgttctggtcacttcatagtcggcagttgcacgcagtttttccgcttcttcctgaccttgtgaacggtgacgacgcgctaccgcttcacgctcggcgcgcatacggttgtagatcgcttcagacacttcggtcggcaggttgatctgcttaattcgcacatcgacaacttcaatacccagcgccgccatactgttcggattgatgaccggaactttgcccttcgtctcagccgttacgcgctctgccgcttcggcaatggcgttatctgctgcaggggtagtaacttcatcttctgtacccgcagaaccggagttcagcgcgtcacgtacttcgagggtcagacgaccacgagaatcggtgacgatgtctttcacgtccaggcgaccaatttcagaacgcagacggtcagagaacttacgtttcaacagcacttccgcttgcgaaatgtcgccaccacccgttgccagatagtaacggctgaaatcgctgatgcgccatttgatgtaagagtcgacgatcaggtctttcttctctttggtcacaaagcggtcggcctggttgtccatggtctgaatacgtgcgtcgagcattttcaccgtttcaatgaacggtatcttgaaatgcagacccggctcataaaccagaggtttgttgtcatcgtcacgcagtaccttaccaaaacgcagcgtaataccgcgctcaccttctttgacgacaaagacagacatgtaaagcactaccagcacgatgatgataatcgcgataactgacttacgcatcgttattccccctgacgctggtagtcgttacgctgcgcgttggcgcggcgttggtccataatatcgccctgactggtggacgacgtgttgcttgctccactggttgtggaggaagaggctggcggcagacgcagcagattgctggcaccgttatcgctcttcgccgcaggggcgttaccacctttcagcatctggtctaatggcagaaccatcaggttgccacctttatcgttaaccagcactttgcgggtgttgcccaacactttttccatcgtctcgatatacagacgctcgcgagtaatttccggcgcggctttatattccggcagaagtttagcaaagcgcgccacttcaccctgagcttccaggatggtctgggccttgtacgcacgcgcctcttcgaggatacgttgcgcctgaccgttcgcacgcggctgaacttcgttggtatacgcttctgcttcacgaatgtattgctgttcgttttcacgcgcggcaatcgcatcgtcaaacgccgcttttacttcttccggcggacgagcagcctggaagttgacgtccagcagagtgatgcccatgtcatacggacgaatcgtctcttccagttcgcgctgagtatcgctacgaatcacggtacgaccttccgtcagaatgcggtccatggtgtatttaccgataaccccgcgcagggcgctgtcggtagcctgacgcagactgtcatccgggctggtcacgctatacagatatttttccggatcggtgacgcggtactgcacgttcatctcaacgcgcactacgttctcgtcagacgtcagcatcacaccagaagctgccagttcacgcacggcttccacgttcaccggtttgacttcgtcaataaacgtcggtttccagttcagacccggctcaaccagatggctgaatttaccaaagcgtgttaccacgccgcgttcggcttctttaatggtatagaaaccactggccgcccagataatgacaatcgctgccgctgcgatggtaacgacgcgaccgccaagctgcgggcgcgggccttgcgatgaactgccaccgccagatccggtgcctttaccgccgcccagaccaccgagctttttgctcagtttgcggaagatatcatctaaatcaggtggcccttgatcgcgaccgcctttgtttccatttccctcagagttgccgccaggtttgctgcttccccacgggtcgcggtcttgtccgttattaccgggctgattccacgccatgtttgtgctccatatttgttatgcggtgatccctgttgtctttcgacgccagaggatatgactccacgcttcagacgctacgccgttagatcaggtaatcgatcaacgccggttcttgtttacagaggcgacgccagtcaacgatcggcatacgaacttgcagacttacgctgccgtcctcctccatccactctttttctattgcctgaagctgataaaaacgacttctcaggcgcccttcctgcggcggcagacgcaatgtatgctgcgccacctcgccggaaagacgctccgtcaaagcctgaaaaagctgtggtatccccgctccggtctgcgcagaaagccagacacggatcggtttgttctcttcatctctgtcaatacgcggttcgaaatcgtccagcatatcgatcttgttcatcaccagcagggttgggatctcgtgagcatcaatctcttcaagaaccgtattcaccgcttcgatgttttcttgtacacgcacatccgccgcgtcaatgacgtgcagcagcaatgtggcttgccgcgtctcttgtaacgtggctttaaatgccgccaccagatcatgcggcaggtggcgaataaaccctacggtatctgccaacacggtttcaccgacatccgcaacatcaatacgccgcaacgtcgggtcgagggtggcaaacaactggtctgccgcgtagacccgcgcttcggtgattcgattgaaaagagtagatttaccggcgttggtatatcccaccagcgaaacagtaggaacgtcggctttgatacgcgattgccgcccctgctcacgctgcttttcaactctttccaggcgcgactgtatctgcacgatgcgattacgcaacaaacgacggtcggtttcgagctgggtttcacccggaccacgcaaaccaatcccgcctttctgtctttcaaggtgggtccagccacgcaccaggcgcgtagccagatggcgcaactgcgccaactcaacctgcaacttaccctcatgggtacgcgcacgttgggcgaaaatatctaaaataaggccggtgcggtcgatgacacgacactcgcacaaacgctccaggttacgctcctgcgccgggctcagggcatggtcaaaaagaacgaccgaagctcccgtcgcttttacggcttccgcaatttcaactgctttaccttcacctacaaaatactttgggtgcggcgctttacggctaccggtaatcacctgcaatgcttcgacaccggcggaagagaccagagattcaaactcctggaggtcttccatatctttgtcttgcgtaaaatagatgtgtaccagtaccgcctgctcaccagcatcataacggtcaaacaagcgtataaccctctaaatagatcagcggggaacgcaggatcgctggctccccgtgtaaaaaaacagcccgaaaccttattcggtttcttcgctgtcctgttgcgcggaagtattctgcgcgctgctaccatgatgatagttactgctggtaccgccaccggcgttgttactgtgatgagaaaccgggcgagacgggacaacagtagaaatcgcgtgcttgtaaaccatctggctgaccgtgtttttcaacaggatcacgaactgatcaaaagactcgatttgtccttgcagcttaataccattcaccaaataaatagaaactggaacacgttcccgacgcagtgcgttcaggaacggatcttgtaaagattgccccttagccattctctcttttccttatatgcttatttgtactttgaacctttcgattctgaaaaaattgcgcacgatacgtctcaattgtacacattcagcctgcgatagcaccaacaacctgtaatacttcgtcacgcgcctgttctggtttttcactgtcaagccagtgaaccccttcccaaccacgcagccaggttatctgccgcttcgccaactgtctcgtggcgcaaacacctcgataaaccatttcatcgtatgagatttcgccttcaaggtaagaccacatctggcgataacccacgcaacgaatggaaggcaaatccgtatgcaaatctcctcgggcaaaaagcgcccggacttctgcttcaaaacctgaagccaacatctgatgaaaacgctgctcaattcgttgatggagcagttcacggctcgccggggcgatggcgaactgatgcacctgatacggtagagcgtctcctgacgtttgcgtcagttccgttaaagttttacccgaaatgaaaaaaacttccagtgcccgggaaagcctttgtggatcatttggatgaatccttgctgccgcaaccggatcgatctcctgaagttgacgatgcaatgactcccaaccttgctctgccgcctgttgctcaattctggcccgtacttccgggtctgccgacggtagcggcgacaacccttccagcaatgccttgaaatacaacatcgtaccgcccactaacagtgggatccgccccgccgcggtgatatcggccatttccgccagcgcatcgcggcgaaaatcagcagccgagtaagcctgcgacggatcgcgaatattcagcaatcggtgcggcgcggcgagtaactcttcagcgttcggcttcgccgtcccgatatccatccctttgtaaataagggcagaatcaacgcttatcaactctactggtaaaattttacgcagctcaatggctaacgccgttttaccggaggccgtcggccccatcaaaaaaatcgccttaggcaggctcgccttactgatatcactcatctttcagggcttttatcgccggatgtaaatcaacagattgtaacagaccacccggcggcgttttcacaagttgcggacataaccgttccacgtccgccagcagggttatggcctgtgccattgaccactgcgcatgttcgctcatcagatttcgtgcaatccactgcgcaatattgccaggttcgaatacggactgcttcgccaggtagcctatcagttcaggaatcaagatttgtaaattttgttggcgtaagggtaaaggcacggccctgatggtcacatgctgcgcatcggactggaaatcaatacccagttccgccagggcagactgcgctttttctaatgccgatttttcttcgccagaaacttttagccgcaacggaataagcagcggttgggcgcaaactggcacttcacccggcgtcaattgtgcctgacgcagccaacgttctgccactggcaaggataaaagtgaaatgttgccatcgcgctcaagcaacgcacagtcggaatggacgatagtcagtacccgaccaaaactctgactgttcgccgcaagtgcaggttcctgcggttctggcgcttttggtttttgcatcggagcgggcgtttgcaaaagctggcgatacacttcaccttgctgtttctggtaaccaggctgcgcattcggccaggaggcagccggacgactgcctgaggcgggcgcaggagagtagcgcggagctaccggctcacgaactgccggttcagcaaagtgattgcgcccagccgccacgcgattttccggaatggcacgcggtgcaggttgtggttcatcgtccagcggtagcggcgtttccagttgctgttgtagcacgctcagcacgccctgatagataaagtcatgcaccagacgcgactgatggaaacgcacttcgtgtttggcagggtgcacgttgacgtccacctgatgcgggtcgatctccagatacaacacaaatgccggttgctgatcggcccccagtttgtcttcgcaggcctggcggatcgcgtgattgatcaggcgatcgcgcatcatgcgaccgttcacgtagcaatactgaatttctgccagtgcgggcgtagtgtgatttggatcggccacccagccgcgcagcgtgagatcgccgtgttgccattcaatcgccagcgcttgttcgagaaaagcggtgccgcaaatcgcgcctaaacgccgttctttttgcccgccttccggcactgcacgatactggcgtacgattttgccgttatgcgacagactgatagtgacgtcgaaacgcgccagcgcaatgcggcggatgatttcatcgatatggttaaattcggttttctcggtgcgcaggaatttgcgccgcgccggggtgttgtagaacaggtccagcacctccagcgtcgttcccaccggatgcgccgccggtttaaccgtcacgtccatatcgcgcccttcggcataggcctgccaggcttcctgctgttctgcggtgcgtgaagtgagcgtcaggcgggaaaccgaactgatactcgccagcgcctcaccgcgaaagcccagactgataatggcttcgagatcgtccagagaggcgattttactggtggcatgacgcgccagcgccagcgccagctcgtcttttttgataccgcagccgttatcacgaatgcgaataagtttcgccccaccgcgttcgatatcaatatcgatacgcgtcgcacctgcatcgaggctgttttccaccagttctttgactaccgacgcaggtcgctcgaccacctcacctgcggcaatctggttcgccagttgtggcggtaagacctgaattggcatcaatcgtccttagtttggcagcgtgcgatctggcgtcgtcaccgtactggccgtttgtgccgttgcaccctgcggcgcagattgcatcggatgcgcaaggaagtaattgcgcaggcctttgtaaatggcttctgccagctgttgttggtaatcgtcgctcgccagcaaacgttcttcgctgttgttactgataaaaccggtttcgaccagtactgacggaatatccggcgaacgcagaacgccgagactcgcgtgttctggtcggcgtttatgtatttcgccaatgcgttgcaactgactgatcatactggtcgctacatcataccctacccgctgggaatgaccgaactgtaaatccagcaccgcctggcttaaataggggtcagactgactgttcgccagcacatcacccgccccgcccagcagctccgactgcttctcatgctgttccagccagcttgccatttcgctgttggcgcgacggtttgagagcacccatacagaggcaccggtggcactacggtttggtgcggcatcggcatgaatcgacacaaggaaattggcgttttgcttacgtgccacatcactgcgccccatcaccgagataaagtaatccccgtcacgggttaaaacgcctttaaacatcggatcgttattgagcaaagtacgcaatttacgcgcgatggcgatggtgacatttttctcccgcgtaccaccggggccgatagcgccaggatcctgaccgccgtgtccggcatcaatagcgatgataattttatcgcctgtgttagccgtcgcgcgcgctgccggacgcgttaccgtattactgctgataacacccgtagtgcggttactttccgttttaaacggattgcgcgccggttcgctgacgcgcggtgcgacaaccgcaggcgtttcaacgcgtttcgcaaccacaggcggcggaggaggcggtggcggcacatcggcgttaatcgtaaagacgacagtgtaattgctgccattctgccgcttcaccgcttcggttttaccattttcggtaagatcgaccaccagccgtagcgtttgtgcatctttaggcgttccagagcgaatcgccttcaccagattattgccgctgaacaacaacggcagtccctgaatcacgcccgtttgtttgatatcgagcgccacggtgcgtttgctttgatggctaaacgcataatcaggatcgccaataaaactcaacgttatccgcgcctgttggttgccgttagaaacctgaatatcagagagcgtcgcggcacccacctgcgcgcacagcagcagcaacgtcgctaccaaccaatttctgatgcgatacatcatcccgccacctttcaaaggttaaccggctaaacgcgccagcaacaattcacccgcagaggaaaccgcactcacgcgcgcctcacggccttgtgcctgataatcaatgtgtatttcgacatccgggtcaggaagaacacctgtaccttgttgtggccactccaccaggcagatggcatcgttggcaaaataatcgcggatccccataaactccagctcctcgggatcggcaaggcggtacaaatcaaagtgataaaccattaaattgtcgagcatatagggttcgaccagcgtataagtggggcttttgacattaccctgatgacccagagcctgtaaaaagccccggctaaaggtggttttacctgcacctaaatcgccatacagatagattacggttgcgccatcgcaggctttcgctacccgctcgcccaggtctaatgttgcctgctcatcagggagcggaattactcgattcatcatggtttttatcagtcacttccgggttaacaatacgctgtagcgtggaaaagagatcggttgccagcatcccgcgcgttccaaaacgcgccgccagtacgtcagctgccgcaccgtgcgcgacacagcccgcacaggctgcatcataagggctcattttttgcccaagcaatgcgccaataataccagagagcacatcgcccatgccgccgctcgccatgcctgcatttccggcatcaataatgcctaaagcgtcaggatgggcggcgaccacggttccggcacctttcagcaccgctacgccgccataacgttgtaccagacgttgggtgcaatgtaagcggtcactttcaatttcagcgacggaacagcctaacaaccgtgcggcctcgccaggatgcggcgtgatcacgcgattgtgacgcttatcgggattgattgccagcaggttcaatgcatcggcatcccacaacatcggtttgcgaaaattctcaactttttgcagggcttttttcccccactcttgctggcccagaccgggaccaatcaccaccacatcggcccattccaggctttcggtaagagagtccatagtcagttcatgcaccatcaattccggtcgtgcagtcagcagcggcgcaatgttctcactgcgggtcagtactcggactaaaccagcgccagcacgcagcgccgcttcccccgtcatacgaatagcccccgccgtgccgtgatcgccaccaataatcaccagccgcccgtgatcgcctttatgcgaagtcgggcgacgcggtatcagccactgagaaagttgttctgccgaaaaccgctgaattttcgtctcctgacctgccagccagctatccagccccagtgagtcaaaatgcagttgtccggtaacatcccgcgcttttccagtgagcaagcctggtttcagcgcaataaaagtgatggtgtgatcggcgttgattaccgcgcctggcgtagcgccggtttcagccagaaggccggaagggatatcaaccgccacaatcggcgcagggtgagtattagcgtggtcgattaactggctaatggattcgcggggcgcttgctgcaagccggtgccgagcagcgcatcaacaatcagatctaccgattcgggccagacaatattcgaagcatggatctcgcctcccgcgtttaaccatgcttcgcgtgccagcgcggcctcttccggcaacggtttgtcactttcctgggccagcagcgtgacatcaataccgatcgctttggccagccgcgcgaccacgtagccatcgccgccgttattaccatgaccgcacagcaccagccagtggcgggcgtcaggataagccgaacgacacacctggaatgcggcttcgccagcgcgaagcatcagctcatagagtgtgagccccagcgcatctgccgcctcgcgttctccgcggcggatatcgtcggcgtaccagacggtgtgtggtatacttacggggtttttcttcattgtatggtccgtcatgtcagagcccctcgatctcaatcaattagcgcaaaatattaaacagtgggggctggaactgggctttcagcaggtaggtattaccgataccgatctcagcgcgtccgagcccaaactgcaagcatggctggacaaacaataccacggcgaaatggactggatggcgcgtcacggtatgctgcgtgctcgtcctcacgaattattgcccggtacgctgcgcgtgatcagcgttcggatgaattaccttcctgctaacgccgcatttgccagcacgctgaaaaatcccaaactcggctatgttagccgttatgcgctgggccgtgactatcacaagcttctgcgcaaccgactcaaaaagctgggcgagatgattcagcaacattgtgtttcgctgaattttagaccgtttgtcgattctgcgcctattctcgagcgcccgttagctgaaaaagcaggtcttggctggacaggtaagcactcacttatcctcaatcgcgaggccggttcgttcttctttttaggcgaattgctggtcgatattccgctgcccgtggatcaaccagtcgaggaaggatgcggtaaatgcgtggcctgtatgacgatttgcccgaccggtgccatcgtcgagccatataccgtcgatgctcgccgctgtatctcttatctcaccatcgaactggagggggcgatcccggaagagttgcgaccgttaatgggaaatcgtatttatggttgcgatgactgccagcttatctgcccgtggaatcgctattcgcaactcactacagaagacgatttcagcccgcgtaagccgctacacgctccggaactcattgagttattcgcctggagcgaagagcagtttttaaaagtcacggaaggttcggcgattcgccgtataggtcacctgcgttggctgcgtaatatcgccgtagcattaggcaatgccccctgggatgaaacgattttgacagcgctggaaagtcgtaaaggtgagcacccacttctcgatgagcacatagcgtgggcgattgcgcagcaaatcgagaggcgaaatgcgtgcatagtcgaagtgcaattaccgaaaaaacagcgtctggttcgggtgattgaaaaagggttaccgcgtgacgcctgattcatccacagcctgtgaataaaaataaaaacgcattgcaattcaagatgaataaaatcgtcaagtgatcgactcgacaaaacggaatcttaatttttaacttatctatcaataggttaaaaaaatactattcaccgtgcgaagtttctttgaaattaagattacagcctgagactgtggataactctgtttacaagagtttgtcagagacaacaaaaaccagcaataacgcatcgcgtcgctgtggatattttattgagagaagaatttggagcgggaaacgagactcgaactcgcgaccccgaccttggcaaggtcgtgctctaccaactgagctattcccgcttgggtggtctgtgctttacagcactttcaaattttggagcgggaaacgagactcgaactcgcgaccccgaccttggcaaggtcgtgctctaccaactgagctattcccgcttgggtggtctgtgctttacagcacttttcaaattttggagcgggaaacgagactcgaactcgcgaccccgaccttggcaaggtcgtgctctaccaactgagctattcccgcgtactacttaattttgctttcgtaattttcgcatttctgcgtcgttacgggaggcgcattatacgagaaatctttccctctgcaacccccctaaaaaattttttttgagtttttatctcaagtgctgaaattatcagcaagacgttcaatttagcgtcaaaatcacgccgccgcaagtggattccggcgcttacgtgaccaggaaaaattttacagcttgataaaatgctcgcggtagtaagccaactccgccaccgattcacggatatcatccatcgcctgatgcgtcccctgcttggtaaagccgtcaagaatttccggcttccagcggcgcgccagctctttcagggtgctaacatcgagatagcggtagtggaagtaggcttccagctccggcatgtatttaaacaggaagcgacggtcctgaccgatgctgttaccacaaatcggcgattttcccgcaggcacccactgttttaagaattcgagcgttgccagttcagcttcacgatcgcccatcgtgctcgctttcacacgctctaccagcccgctggcggtatgggtgcgcacgttccagtcatccatcagcgccagctgttcatcggactgatgtactgcaatggtcggcccttctgccagaatattcaggttggcatcggtcaccagcgtggcaatctcaataatgcgatcgcgctcgggatccagaccggtcatctcaagatcgatccaaatcaggttgttttcattggcactcatgctattttccacccattcacagtgactatattgatccacaattgcgtgtatcatagatgttttgcccatcaggggcgaccaggagtctgtacgattgagtaaaaataaactctccaaaggccagcagcgccgcgtgaacgccaatcaccagcgtcgtcttaaaacgtctaaggagaagcccgactacgacgacaatctgtttggcgagcctgatgaaggtatcgtcatcagccgctttggtatgcacgctgatgtggaatccgccgatggcgacgttcaccgctgcaatattcgccgtaccatccgttcgttggtgaccggcgaccgcgtagtctggcgtccgggtaaaccagcggcggaaggcgtaaatgtcaaagggatcgtggaagcggtgcatgagcgcacctcagtgttgacgcgcccggatttttacgacggtgtgaaacctattgctgccaacatcgaccagattgtcattgtctccgccattttgccggagctgtcgctcaatattatcgaccgttacctggtggcctgcgaaaccttgcagattgagccgattattgtgctcaacaagatagacctgctggacgacgaaggcatggagttcgtcaacgagcagatggatatctaccgcaatatcggttatcgcgtattgatggtttccagtcatactcaggatgggctgaaaccgctggaagaggcgttgaccgggcgcatcagcatttttgccgggcagtctggcgttggcaaatccagcctgctgaacgcgttgctggggctgcaaaaagagatcctgaccaacgatgtctctgacaactcggggcttggtcagcacaccacgaccgccgcacgactgtatcacttcccgcacggcggtgatgtgattgattccccaggtgtgcgtgagtttggtctctggcacctggagccggaacaaatcactcagggctttgtcgaattccatgactatttaggtctgtgtaaatatcgcgattgcaaacacgatacagatccgggctgcgctatccgggaagcggttgaggaaggaaaaatcgcggaaacccgtttcgaaaactatcaccgtattctggaaagcatggcgcaggtaaaaacgcgtaaaaacttttctgatacggatgactgacaattaagctaaccgtcgttagaatcgtcccctttttttcaggatccggcatgtaggccggatcaggaacgacaaaacaatggcctggaggctaccttgttaaattcatttaaactttcgctacagtacattctgccgaaactatggcttactcgcctggcgggttggggcgcaagcaagcgggcaggatggctgacaaaactggttatcgatctgttcgttaaatactacaaggtcgacatgaaagaggcgcaaaagccggacaccgccagctaccgcacctttaacgaattctttgtccgtccgctgcgtgacgaagtacgcccaatcgataccgatccgaatgtactggttatgcctgccgatggcgttatcagccagttgggtaaaatcgaagaagataaaatcctgcaagccaaaggccacaactacagcctcgaagccctgctggcaggcaactatctgatggcggatctcttccgtaacggtacgtttgtgaccacttacctctccccacgtgactaccaccgcgtacacatgccgtgcaacggtattctgcgtgaaatgatctacgtgccgggcgatctcttctccgttaaccatctcacggctcagaacgtgccgaatctgtttgcccgtaacgaacgcgtgatctgcctgttcgataccgaatttggcccgatggcgcagattctggtcggtgcgacgattgtaggcagcattgagacggtctgggcgggcaccattacgccgccgcgcgaaggcatcatcaagcgctggacctggcctgccggggaaaacgacggttctgtggcattgctgaaaggccaggaaatgggtcgctttaaacttggctctaccgttatcaacctgtttgcaccaggtaaagtgaacctggttgagcaactggaaagcctgtctgtcacgaaaattggccagccgctggcagtatctaccgaaacctttgttacgccagacgctgaaccagccccgcttcctgctgaagaaatcgaggcagaacacgacgccagcccattggttgacgacaaaaaagaccaggtctaatccatcaaaggaaacgctgacgtgcgcctgattatcacttttctgatggcctggtgcctcagttggggggcgtacgccgcgacggcccccgatagcaaacaaatcacccaggaactggagcaggcaaaagcggcgaaacccgcgcagccggaagtcgtagaggcgctccagtctgccttaaatgcgcttgaggaacgaaaaggttcccttgagcgcatcaagcaatatcaagaagtcattgataattatccgaaactttccgccactctgcgcgcgcagttaaacaacatgcgtgacgagccacgcagcgtgtcgccgggaatgtctaacgatgcgctgaatcaggaaattctccagatcagcagtcagttgctggataaaagccgtcaggcccagcaagagcaggagcgcgcccgcgagattgccgattcgctgaatcaactgccgcaacagcaaaccgatgcccgccgtcagttgaatgaaatcgagcgccgcctggggacgcttaccggcaataccccgctcaatcaggcacaaaatttcgcgttgcagtctgactccgcacgtctgaaagcgctcgttgatgaactggagctggcgcagctatctgccaataaccgccaggaattagcgcgcttgcgctctgagctggcggaaaaagagagccagcagctggatgcatatttgcaagcactacgcaaccagttgaatagtcaacgccaactggaagcggaacgggcgctggaaagtaccgagcaactggcggaaagtagcgccgatttgccaaaagatatcgtcgcccagtttaaaattaaccgcgaactatcggcggcgctgaatcaacaggcgcagcggatggatctcgttgcctcgcaacagcgtcaggctgccagccagacgttacaggtccggcaggcgttgaatacgctgcgtgaacagtcgcaatggctgggatcatctaacctgctcggcgaagcgttgcgggcgcaggtggcacggctaccggaaatgccaaaaccacaacagcttgataccgaaatggcgcagttacgtgtgcaacggttacgttatgaggatctgcttaataaacagccgctgctacggcaaatccatcaggccgacagtcagccactgaccgctgagcaaaaccgtattctggaagcacagctacgcactcagcgtgagttgctgaactcattgttgcagggtggcgacacgctactgctggagctgaccaagctgaaagtctccaacgggcaactggaggatgcgctgaaagaggtgaacgaagcgacgcaccgctatctgttctggacctctgacgtgcgcccgatgaccatcgcctggccgctggaaatcgcccaggatctgcgtcgtctcatttcgctggacaccttcagtcagttgggcaaagccagtgtgatgatgctgaccagtaaagagacgattttgccgctgtttggcgcgttgattctggtcggttgcagtatttactcgcgccgctatttcacccgttttcttgaacgttcggcggcgaaagtcggcaaagtgactcaggatcacttctggctgacgttacgcactcttttctggtcgattctcgtcgcgtcaccgctgccggtgctgtggatgacgctgggttacggcttgcgcgaggcgtggccttatccgctggcggtcgcaattggtgatggcgtaacagccaccgtaccgctgctatgggtagtgatgatttgcgctacctttgcccgcccgaacggcttgtttatcgctcattttggctggccgcgcgaacgggtttcccgtgggatgcgctactacctgatgagcatcgggcttattgtgccgctgattatggcactgatgatgttcgataacctcgacgaccgtgaattctccggttcgctgggacggctttgctttatcctcatttgcggtgcgctggcggtggtcactctcagtctgaaaaaggccgggatcccgctgtatctcaacaaagaaggcagcggcgacaacattaccaaccatatgctgtggaacatgatgattggcgcaccgctggttgccattctggcgtcggcggtgggttatctggcaacggcgcaggcgctgttagcgaggcttgaaacctcggttgccatctggttcctgctactggtggtttatcacgttatccgccgctggatgctgatccagcgccgcaggctggcgtttgaccgggcgaagcatcgccgggcagagatgttagcgcagcgtgcgcgtggcgaagaggaagcgcatcatcacagtagcccggaaggagcaattgaagtcgatgaaagcgaagtcgatctcgatgccatcagtgcgcaatccttgcggctggtgcgctcaattttgatgttgatcgccctgctttcggtcattgtgctgtggtcagaaatccattccgctttcggcttcctcgaaaatatttcgctgtgggatgtcacttccacggtacagggcgtagaaagcctggagccgattaccctcggtgcggtgctgattgccattctggtgtttatcatcaccacgcagctggtgcgcaacctgcccgcgctgctggaactggcgattctgcagcacctggatttaacgccgggtacgggctacgccatcaccaccatcaccaaatatctgctgatgctgattggcgggctggtcggcttctcgatgattggtattgagtggtcgaaattgcagtggctggtcgccgcgctcggtgttggtctcggttttggtttgcaggaaattttcgccaactttatctctggcctgattatcctgttcgaaaaaccgattcgcattggcgatacggtaacgatccgcgatcttaccggtagtgtgacgaaaattaacacccgcgccaccaccatcagtgactgggaccgcaaagaaattatcgtgccgaacaaggcgtttattaccgagcagtttatcaactggtcgctctctgactcggtcacgcgcgtggtgttgacgattccggcccctgccgatgccaacagtgaagaagtgacggaaatcctgctcaccgcagcgcgtcgctgctcgctggtaatcgataacccagcaccggaagtcttcctggtggatctgcaacaggggattcaaattttcgagctgcgtatttacgccgctgagatgggtcaccgtatgccactacgccatgagattcaccaactgattctggctggcttccacgcccacggtatcgatatgccattcccgcccttccagatgcgtctggaaagcctgaatggtaagcaaacggggagaacattaacttctgcgggcaaaggtcgtcaggcgggaagtttgtaatgcatgaagctgccaaatgatgtcaacgtggctcatttagcagcttaacatcatcttcagttatcactggccccggagagtatcatccatacgcattacttcctgacaactcatcgccggagagacgatgagttgcaggatttcatatgatcagtcgagagctaactcaggtttgttcgccatgcgactgcaatagttctggtaaatcgccatcgctaacagcgagaagaagacagggccgccaatcatccacaatgtgctgtcccagtctccagcttcaaccacaggttgaatgatggtgaagacgttcgcaaatgtcaccaccagtacgacaaccactgttgcaatcattgccgacatatgcgttttgaaaatcacaaacggtctgtcgagatcctgacgtgctttaaaaaatgggaaagccagcgcgaggaacaggtaaggaagcgtcatagacacgttcgccatcagcgtcagcttgttaaagaacgccgatgcggtaccgccaccaaacgaaaccagcagaatgaagatagtaaccaacccgcactgcatccacatagcaatagacggcatccccatcgtattcaggcgcgtcatcggttccggccacaatgctttcggcgttccctggatgatggctttcagcggtgaatagcaaagcgtaaagaacgcaccggtataagcgaggaacatcgacagtccggtaatacgcgcaaaccatacgcccagcgacaatgacgcttcaggtgacaaatgcagtgcgttacccagcgtcaccccgaggctcttcatcagcacataggtaatattgccgaggttaacggaaccattacttaatacctgctgccagtttgtgctgacgccccataaaaatattgccagcgaataaccgattgaaataacaatagcggcaaaaacaatacctttggcaaagttcttttctggattttccgttttatcaaccagaccaccaaccgcttcaattccaccataggcaaaaatggcaaataccacaaacgatagcattgccagaccggactgataacctgggttcggtgatgccaggaaattaatatcctgcgcgaaatgcccaccatttaataacaaaatagtaatgcttactaacagcaatactaaattcagacacattactgcaataccgcccaccgcagtaatgcgggcaattttattaatcccttttgaagcaacgacggtgaccagaatcatccatgccactgccagcagaccaaccacctgcgtaggctccagtccggcaatatgccagtgctgggtcatgtcgctaccgtagaggaatgttgagaacggtacccaaactttcgcggaggtactcaccatccagatgatataagaggaaaaccacataaacgtaccaatgaaggcaaaacgtggtccgacactattattcatccaggaatagataccgccttcttctttgcgataagcagctcccatttcagccatcattaaggcgaatggaataaagaataacaatgcagaaaatatataaaagggaatcgcactataacccattaagtaataagccgatgggctattggcaaatccaaatacagaagtaaagatcatcaatatgagtcctatcagactcatcttttttatcgagtgaggcatgaaaccatccttcatttcagcgcgtgtataaaacgcgcccactgaactgcactgcccaacattgagcgggcagcgtaaaaaccaatacagaattgatacctggatgatatcaaatatccagtcttaaattgtggcctttagcggaaaaatgaaaacatatgctacagaatggcgcttatcacgccattcttcgctgttaattcagtaatttttcagaattatgcccggtcaacgctaaaggcgatgacttcagccagtgtctccgcgcccagcgccaacatcaccagacgatcaacacctaatgccacgccggaacagtcaggcataccgactttcaaggcttcaatcagattctggtcaatggggtgctgcggcaaaccgcgcgccgcgcgcttacggttatcttgttcaaagcgttgttgctgctcacgggcatccgtcaattcatggaaaccattcgccagctcaatacctttataataaacctcaaagcgttcagcgacccgatgatcttcggtactgatttgcgccagtgatgcctggctggctggaaagtggtacacaaaggtcggtttttctttgccaatatttggctctacgccaaaggtaaacagcaattgtagaagcgtgtcgcggtcttcttcagtatcggcaacgttgctcaaatccagtttcgctgccacttcccgcagttgcgttttgtcggcagagagtgggtcaatttccagataacgtaagaaagcttgttgataagaaaggctttctgctgccggacagtccagcacctgttgcaagagatcgtccacctcgttcatcaaccggtacatatcatagtgcggtcgataccactcaagcatagtgaactcagggttgtgataacgccccatctcttcattacggaagctgcggcacagctggaataccggcccacaaccggcaaccagcaggcgcttcatatggtattccgggctggtcattaaccagagattcatcccctgcgaatgcccggggccaacgaaacgtgtctcaaacgggaccaaatgaatatcggttaccgtcgcctggctcatacaaggcgtctccacctccagcactccacgatcggcaaagaaacgacggatctccgccataatcgccgcgcgttttaataagttaggaatggatgcgctcggctgccaggatgccgtttcgctcatagttaaatctccagtttttgacaagggcacgaagtctactcgcaacgcgacggcgagacaaattttacgcaggaataacacaacggtgggcagtgactaaaaaaagcacgatctgatggtttagtaattaaattaatcatcttcagtgataatttagccctcttgcgcactaaaaaaatcgatctcgtcaaatttcagacttatccatcagactatactgttgtacctataaaggagcagtggaatagcgttcgcagaccgtaactttcaggcacttaccctgaagtacggggctgtgggataaaaacaatctggaggaatgtcgtgcaaacctttcaagccgatcttgccattgtaggcgccggtggcgcgggattacgtgctgcaattgctgccgcgcaggcaaatccaaatgcaaaaatcgcactaatctcaaaagtatacccgatgcgtagccataccgttgctgcagaagggggctccgccgctgtcgcgcaggatcatgacagcttcgaatatcactttcacgatacagtagcgggtggcgactggttgtgtgagcaggatgtcgtggattatttcgtccaccactgcccaaccgaaatgacccaactggaactgtgggggtgcccatggagccgtcgcccggatggtagcgtcaacgtacgtcgcttcggcggcatgaaaatcgagcgcacctggttcgccgccgataagaccggcttccatatgctgcacacgctgttccagacctctctgcaattcccgcagatccagcgttttgacgaacatttcgtgctggatattctggttgatgatggtcatgttcgcggcctggtagcaatgaacatgatggaaggcacgctggtgcagatccgtgctaacgcggtcgttatggctaccggcggtgcgggtcgcgtttatcgttacaacaccaacggcggcatcgttaccggtgacggtatgggtatggcgctaagccacggcgttccgctgcgtgacatggaattcgttcagtatcacccaaccggtctaccaggttccggtatcctgatgaccgaaggctgccgcggtgaaggtggtattctggtcaacaaaaatggctaccgttatctgcaagattacggcatgggcccggaaactccgctgggcgagccgaaaaacaaatatatggaactgggtccacgcgacaaagtttctcaggccttctggcacgaatggcgtaaaggcaacaccatctccacgccacgtggcgatgtggtttacctcgacctgcgtcacctcggcgagaaaaaactgcatgaacgtctgccgttcatctgcgaactggcgaaagcgtacgttggcgtcgatccggttaaagaaccgattccggtacgtccgaccgcacactacaccatgggcggtatcgaaaccgatcagaactgtgaaacccgcattaaaggtctgttcgccgtgggtgaatgttcctctgttggtctgcacggtgcgaaccgtctgggctccaactcgctggcggaactggtggtcttcggtcgtctggccggtgaacaagcgacagagcgtgcagcaactgccggtaatggcaacgaagcggcaattgaagcgcaggcagctggcgttgaacaacgtctgaaagatctggttaaccaggatggcggcgaaaactgggctaagatccgcgacgaaatgggcatggcaatggaagaaggttgcggtatctaccgtacgccggaactgatgcagaaaaccatcgacaagctggcagagctgcaggaacgcttcaagcgcgtgcgcatcaccgacacttccagcgtgttcaacaccgacctgctctacaccattgagctgggccacggtctgaacgttgctgaatgtatggcgcactccgcaatggcacgtaaagagtcccgcggcgcgcaccagcgtctggacgaaggttgcaccgagcgtgacgacgtcaacttcctcaaacacaccctcgccttccgcgatgctgatggcacgactcgcctggagtacagcgacgtgaagattactacgctgccgccagctaaacgtgtttacggtggcgaagcggatgcagccgataaggcggaagcagccaataagaaggagaaggcgaatggctgagatgaaaaacctgaaaattgaggtggtgcgctataacccggaagtcgataccgcaccgcatagcgcattctatgaagtgccttatgacgcaactacctcattactggatgcgctgggctacatcaaagacaacctggcaccggacctgagctaccgctggtcctgccgtatggcgatttgtggctcctgcggcatgatggttaacaacgtgccaaaactggcatgtaaaaccttcctgcgtgattacaccgacggtatgaaggttgaagcgttagctaacttcccgattgaacgcgatctggtggtcgatatgactcacttcatcgaaagtctggaagcgatcaaaccgtacatcatcggcaactcccgcaccgcggatcagggtactaacatccagaccccggcgcagatggcgaagtatcaccagttctccggttgcatcaactgtggtctgtgctacgccgcgtgcccgcagtttggcctgaacccagagttcatcggtccggctgccattacgctggcgcatcgttataacgaagatagccgcgaccacggtaagaaggagcgtatggcgcagttgaacagccagaacggcgtatggagctgtactttcgtgggctactgctccgaagtctgcccgaaacacgtcgatccggctgcggccattcagcagggcaaagtagaaagttcgaaagactttcttatcgcgaccctgaaaccacgctaaggagtgcaacatgacgactaaacgtaaaccgtatgtacggccaatgacgtccacctggtggaaaaaattgccgttttatcgcttttacatgctgcgcgaaggcacggcggttccggctgtgtggttcagcattgaactgattttcgggctgtttgccctgaaaaatggcccggaagcctgggcgggattcgtcgactttttacaaaacccggttatcgtgatcattaacctgatcactctggcggcagccctgctgcacaccaaaacctggtttgagctggcaccaaaagcagccaatatcattgtaaaagacgaaaaaatgggaccagagccaattatcaaaagtctctgggcggtaactgtggttgccaccatcgtaatcctgtttgttgccctgtactggtaaggagcctgagatgattaatccaaatccaaagcgttctgacgaaccggtattctggggcctcttcggggccggtggtatgtggagcgccatcattgcgccggtgatgatcctgctggttggtattctgctgccgctagggctgtttccgggtgatgcgctgagctacgagcgcgttctggcgttcgcgcagagcttcattggtcgcgtattcctgttcctgatgatcgttctgccgctgtggtgtggtttacaccgtatgcaccacgcgatgcacgatctgaaaatccacgtacctgcgggtaaatgggttttctacggtctggctgctatcctgacagttgtcacgctgattggtgtcgttacaatctaacgcatcgccaatgtaaatccggcccgcctatggcaggccgttttgtatggaaaccagaccttatgctcaaaacgacgctctgcaccttattaattaccgcctcttgctccacatttgccgcccctcaacaaatcaacgatattgtgcatcgcacaattaccccgcttatagagcaacaaaagatccccggtatggcggtggcggtaatttatcagggtaaaccttattactttacctggggctatgcggacatcgccaaaaagcagcccgtcacacagcaaacgttgtttgagttaggttcggtcagcaaaacatttacgggcgtgcttggtggcgacgctattgctcgaggggaaatcaagttaagcgatcccacaacaaaatactggcctgaacttaccgctaaacagtggaatgggatcacactattacatctcgcaacctacaccgctggcggcctgccattgcaggtgccggatgaggtgaaatcctcaagcgacttgctgcgcttctatcaaaactggcagcctgcatgggctccaggaacacaacgtctgtatgccaactccagtatcggtttgttcggcgcactggctgtgaagccgtctggtttgagttttgagcaggcgatgaaaactcgtgtcttccagccactcaaactcaatcatacgtggattaatgtaccgtccgcagaagaaaagaactacgcctggggatatcgcgaaggtaaggcagtacatgtttcgccaggggcgttagatgctgaagcttatggtgtgaagtcgaccattgaagatatggcccgctgggtgcaaagcaatttaaaaccccttgatatcaatgagaaaacacttcaacaagggatacaactggcacaatctcgctactggcaaaccggcgatatgtatcagggtctgggctgggaaatgctggactggccggtaaatcctgacatcatcattaacggcagtgacaataaaattgcactggcagcacgccccgtaaaaccgattacgcccccaactcctgcagtacgcgcatcatgggtacataaaacgggggcgaccggcggatttggtagctatgtcgcgtttattccagaaaaagagctgggtatcgtgatgctggctaacaaaaactaccccaatccagcgagagtcgccgccgcctggcagattctcaacgctctacagtaaaatttcatcgggtccgaattttcggaccttttctccgcttttccttgctgtcatctacacttagaaaaaaaccagtaaggaaacatttatgcgcctgctccctctcgttgccgcagcgacagctgcatttctggtcgttgcctgcagttcccctacgccgccgcgtggcgtgaccgtagtgaataatttcgacgctaaacgttatctcggtacctggtatgagattgcccgttttgatcaccgctttgaacgtggactggaaaaagtcaccgcaacatacagcctgcgtgatgacggcggcctgaatgtcattaataaaggctataaccctgacagagaaatgtggcagcagagtgaagggaaagcgtactttaccggcgcaccaactcgcgctgcgctgaaagtgtcattctttggtcctttctatggcggttataacgttattgcactcgatcaggaataccgccatgcgctggtttgcggcccggaccgcgactacctgtggatactctcccgcacgccaaccatttctgacgaagtgaaacaggagatgctggcagtcgcgacccgggaagggtttgatgtcagtaagtttatttgggtacagcagcccggtagttaatgagtgctgagtttcagaccaataatccccaatacgattaacgccagactcgccaggcgcatcggattagcggactcaccgagcagcacaatgccggtgatggccgcgccgactgcgccaatacccgtccacacggcataagccgtccctactggtaacgatttcatcgcccaggcaagtagcgccatactgacaatcatcgccgtcacggtaataacacttggcgtcaaacgactaaagccgtgagtatatttcaggccaacggcccataccacttccagcagaccagcaataactaagataatccaggacatatcaggctccggaaaattggggccgtccccggtgaaaagacgcgtttgcaggtcgtcctgcaaagctgatggttgaacggatattttgccaggtggcaggggaatttcaactattacctatgtaactatcgcagaaaaaacaaacggcacgacacagctgtcgtaccgttattgcttattgcttattgctgcgctttcgttgctgcgccagaaatcgcgttaccgccatcagaaatgtcttcaccaacgccacgcgtggtgttgcaggcagttaatactgttgaaagcaccagaacagaaaagatcgctgcaattgtcttcttcaccataacgtcttccttttaggtaatgttatttatgtttgcctatagcaaattaataatagacaacatcgccaaaaatgatggaaatctgatgatttttcggaagagaagaaaaattagctggcagcgcgggagatggagttgccgaggtgtttgatatcttcgccgaaaccgcgagcggtgttacagcccgtaagcagcgtgctggcaagcaaaacaagaacgataaggcgtttcatcatctctgacctgaataagtgatggtgcagcctgcaggccgcaccacaaccgcattacttcacgcgagagacgtattcaccagagcgggtatccactttgatgacttcgccgatttgtacaaacagcggaactttaaccacagcgccagtagacagggtagccggtttgccgccagtacctgcggtatcacctttcaggcccggatcggtatcaacgatttccagttcaacgaagttcggcggagtaacggagatcggctgaccattccacagagttacgatacactctgcctgatccagcaaccatttagcgttgtcgccaattgcttttgcgtcagcagacagctgctcgaaagtttcgttgttcatgaagtgccagaactcaccgtcgttgtacaggtaagtcaggttcatatcgacaacatcagcgccttcagcggaatcagtagatttgaaggttttttctacgcgagtaccggtcagcagacgacgcagtttaacgcgagcaaatgcctggcctttacccggttttacgaattcactcgcttcaaccgcgtaaggttcgccgtctaacatgattttaagaccagcacgaaaatcgttgctatagtacgttgccataaggccctctgaaatttgttaattggtagctaagccacaaaatggcgcatattgtaaccctaaataccccatccagagaagattggttaacgcaacttgccgatgttgtgaccgatcctgatgaacttctgcgtcttttgaatatagacgcggacgaaaaactgttggccggacgcagcgccaaaaagctgtttgccctgcgtgtgccccgctcatttatcgatcgcatggagaaaggcaatccgaacgatccgcttttgcgtcaggtacttacctcgcaagatgagtttgtcgtcgcgcccggattctccaccgacccgctggaagaacagcatagcgtagtgcctggtttgttgcataaataccacaaccgggcgcttttgctggtcaaaggcggctgcgcggtaaattgccgctattgcttccgtcgccacttcccctatgccgaaaatcagggcaataagcgtaactggcagactgcacttgagtatgttgctgcgcatccggaactggacgagatgattttctccggcggcgatccgctgatggcgaaagatcacgagctggactggttgctcacacaactggaagccatcccgcatatcaaacgtctgcggattcacagccgtctgccgattgtgatcccggcacgcatcacagatgcgctggttgaacgcttttctcattctacgctgcaaatcttgctggtgaatcacatcaaccatgccaatgaggtagatgaaacattccgtcaggcgatggctaagttgcgccgggtgggcgttactttgctgaaccagagcgttctgttacgtggtgtgaacgataacgcgcaaacgctggcaaacctgagtaatgcgttgttcgatgcgggcgtgatgccgtattacctgcatgtgctcgataaagtacagggcgcggcgcattttatggtgagtgatgacgaagcacggcagattatgcgtgagttgctgacactggtgtcgggatatctggtgcctaaactggcgcgagaaattggcggcgaacccagcaaaacgccgctggatctccagctacgccagcagtaactgattaaacagggaagtttaatctttgcccgttgcataacctttaattattcatatacattgctgttgttactctttatataaccaacaccaataattaacctttcttttctgtttatatagagtgagcacggctatttatgttattttaacaactattactaccaagcccatttatctggcttataaactaaaattaattatttaattgagaaatggttagggagaacctacatggccataagcatcaagggtgttaataccggtgttattcgcaagagtaataatttcattgcactggcgctgaaaattaaagaacctcgcaataaagaatcgttgttctttatgtctgccatggaattgcgcgaccttctgattgcgctggaaagtcgtctgcatcaaaagcataaactggatgctgctgcacgccttcagtatgaacaagctcgcgataaagtcattaagaaaatggcagaaaatatcccagaaattctggttgatgagcttaaaaatgccgatattaatcgtcgggttaacacgctggaacttaccgatgatcagggcgaaaatcttaccttcgtattaacgctacatgacggtagcaaatgtgagttagtcgtcaatgagttgcagattgaaatgctggcgcgagcaatcattcatgcaattaataatgcggaaatgcgtgaactggcattacgtattacctcactgttagatttcctgccgttatacgacgttgactgccaggaaaatggcaatctggaatatgacacctattcccaaccggaatggaaacataacttgttcaaccattatctggcggtgctttaccgctttaaagatgaaagtggcaatgaacaatttagcggcgcagtggtgaaaacgcgtgaagcaacgccgggtaaagaagtggaggcgatcactcgccgaatgcttgatttcagcccccgactgaaaaaactcgcgggtgtgccatgtcaggtctatgttcgcaccgtagcggcaaataacgcccaaccgctaacccaggatcaatgcttacgcgcgctgcatcacttacgtgttcaatccaccagcaaaactgcaccacaggcgaaataatctcatctgttttactacgaggctggaagtatccagcctctggatcacatcagttcgggcacttataaacctgaccgataatctggctatccgtcgggacaaaactggacaacattccctgcgacgggctgctgatgccataaatcacgttaccgcccattgcagccgcctggttgcgcagatcgtttgctgcgccgcgcatagaaccgccttcttctccgtgttgcccggaaagccagttgctttgcttacctgtcgcagtaccaatcagctggcactctgcacctggttgctcgtccacaatgcgtacactctgaccggcagcactcaattcgttgctggagctacaacccgccatcagtagcgcggcaccgacaatccctgctaagtattttacgtgcatgttattccccataatcaatgagctggacgccactcgcgtcgtccgtgtctgaatcttatactagaaagatgaccaaaagaaaaacccccagacatttctgcccgggggtttgtttatttctgcgaggtgcagggcaattacatcatgccgcccatgccacccatgccgcccataccgccagcagcgcctaagtcagctgcatcgtttttcggcaggtcggtaaccatgcactcggtggtgatcatcaggccagccacagaagccgcgtactgcagagcagaacgggttactttggttggatccaggatacccatatcgatcatgttgccgtattcttcagttgctgcgttgtaaccgtagttgccgtcgccgcctttaacggtgttagcaacaacagacggttcttcgccgcagttcaggacgatctgacgcagcggagcttccattgcacgcagtgcaactttgatacccacgttctggtcttcgttctgaccacgcaggtcagccagtttagacgctacgcggatcagcgcaacaccaccaccagcaaccacgccttcttctaccgcagcacgggtcgcgtgcagggcgtcttcaacgcgtgcttttttctctttcatttcaacttcggtagcagcaccaactttgataactgcaacgccgcctgccagtttcgctacgcgctcctgcagtttttcacggtcgtagtcagaagttgcttcttcaatctgctgacggatctgagcaacacggccctggattgcagcttcttcacccacgccatcgatgatggtggtggtgtctttgttgatcacaacacgtttagcctgacccaggtcttccagggttgctttttccagctccataccgatctcttcagagattacggtaccgccagtcagggttgcgatatcctgcagcatagctttacgacgatcgccgaagcccggagctttaaccgcagcaactttcacgatgccacgcatggtgttaacaaccagagttgccagtgcttcgccttcaacatcttcagcgatgatcagcagcggtttacctgctttggcaacagcttccagaaccggcagcatttcgcggatgttggagattttcttgtcagccaacaggatgaacgggctttccagttctactgcgccagtttccggcttgttgatgaagtaaggagacaggtagccacggtcgaactgcataccttcaaccacgtccagttcgtcctgcagaccggtaccgtcttcaacggtgataacgccttctttaccgactttgtccatcgcttcagcgatcagtttacctacggtttcgtcggagttagcggagatggtaccaacctgagcaatcgctttagagtcggagcatggtacggacagtgttttcagttcttcaaccgcagcagcgacagctttgtcgataccacgtttcagatccatcgggttcatacccgcagcaacagctttcagaccctcagtgatgatagcctgagccagtacggttgcagtggtggtaccgtcgcctgcagcgtcgttcgctttagaggcaacttctttcaccatctgcgcacccatattttcgaacttgtcttccagttcgatttcacgagcaacggaaacaccatctttggtgatggtcggtgcaccgaaagatttatccagaactacgttacggcctttcggaccgagggtaactttcactgcatctgccagtacgtttacgccgcgcagcattttcacacgagcgtcgttaccgaattttacgtctttagctgccattatctttattccttaaattcgtatgttcagtgtcgtgcgcggattacgcttcaacaattgccagaatgtcgctttcggacatgatcaacacttcttcattgtcgatcttctcagatttcacaccgtagccatcgttgaaaataacgatgtcgccaactttcacatccagcggcttcacttcgccattttcaaggatacggccattgccgacagccagcacttcgccgcgggtggatttagccgctgcagagccggtcagaacgatgccgccagcagatttagtttcaacttctttacgcttgacgatcacgcgatcatgcaatggacgaatattcattgataactctcctttgagaaagtccgtatctgttatgggtgacgccggagcttacgtggtttcccggctggtgaccagagaaatggggatgaggcttcgccccttcaagggggaaaaagaaaaaaaattctgatcagcacaaaatcgggtgaaaaccctgattcacctcacatttcatcgctatttcttcatcaccgtcataagcgaatctgattgtgctaccatcgaaaatctacgcagttgcccaaaatttgggcgcaatcggatatcaacccatgagtggactcaaacaagaactggggctggcccagggcatcggcctgctatcgacgtcattattaggcactggcgtgtttgccgttcctgcgttagctgcgctagtagcaggcaataacagcctgtgggcgtggcccgttttgattatcttagtgttcccgattgcgattgtgtttgcgattctgggtcgccactatcccagcgcaggcggcgtcgcacacttcgtcggtatggcgtttggttcgcggcttgagcgagtcaccggctggttgtttttatcggtcattcccgtgggtttgcctgccgcgctacaaattgctgccggattcggccaggcaatgtttggctggcatagcgggcaactgttgttggcagaactcggtacgctggcgctggtgtggtatatcggtactcgaggtgccagttccagtgctaatctacaaacagttattgccgggcttatcgtcgcactgattgtcgctatctggtgggcgggcgatatcaaacctgcgaatatccccttccctgcgccaggaaatatcgaacttaccgggttattcgctgcgttatcagtgatgttctggtgttttgtcggtctggaagcatttgcccatcttgcctcggaatttaaaaatccagagcgtgattttcctcgtgctttgatgattggcctgctgctggcaggattagtctattggggctgtacggtagtcgtcttacacttcgacgcctatggtgaacaaatggcggcggcagcatcgcttcccaaaattgtagtgcagttgttcggtgtaggagcgttatggattgcctgcgtaattggctatctggcctgctttgccagtctcaacatttatatacagagcttcgcccgcctggtctggtcgcaggcgcaacataatcctgaccactacctggcacgcctctcttctcgccatatcccgaataatgccctcaatgcagtgctcggttgctgcgtggtgagcacattggtgattcatgctttagagatcaatctggacgctcttattatttatgccaatggcatctttattatgatttatctgttatgcatgctggcaggctgtaaattattgcaaggacgttatcgactactggcggtggttggcgggctattatgcgttctgttactggcaatggtcggctggaaaagtctctacgcgctgatcatgctggcggggttatggctgtttctgccaaaacgaaaaacgccggaaaatggcataaccacataatccggcgtttcgacattaatcctggcgatcgtctttatgatcaaggcggtcgcggtcatcatcctttcgctggtactcaccatcaaaagtattaccgccaccggtcccggcgctaaaaccgccgcctggcatacgggaaaaacgcagatgaggcatcaacttcactgtcagatgcttttgcaccggcggtaataaaagaagcaaaccgaggaaatcggtgaaaaagcccggtaataaaagcagcaaaccggcaatgatcagcgaaacacttttaatcatctccgccgctgggttttcacccgccgccattttttgctgcatcagcacgaaattcttaaagccctggttacgtaccagtgacataccgataactgacgtgaatataaccagcacgagggtcagcaatacccccaatacatgagcaacctgaataaagattgaaatctcaatatagacataaaggaaaatggcaataaaaggtaaccagcgcaaaggtttctcctgtaatagcagccggttaaacccggctacctgaatgggttgcgaatcgcgtttagcttatattgtggtcattagcaaaatttcaagatgtttgcgcaactatttttggtagtaatcccaaagcggtgatccatttcacaaattaataattaaggggtaaaaaccgacacttaaagtgatccaggttacggtagaaatcctcaagcagcatatgatctcgggtattcggtcgatgcaggggataatcgtcggccgaaaaacattcgaaaccacatatattctgtgtgtttaaagcaaatcattggcagcttgaaaaagaaggttcacatgtcaaacaacattcgtatcgaagaagatctgttgggtaccagggaagttccagctgatgcctactatggtgttcacactctgagagcgattgaaaacttctatatcagcaacaacaaaatcagtgatattcctgaatttgttcgcggtatggtaatggttaaaaaagccgcagctatggcaaacaaagagctgcaaaccattcctaaaagtgtagcgaatgccatcattgccgcatgtgatgaagtcctgaacaacggaaaatgcatggatcagttcccggtagacgtctaccagggcggcgcaggtacttccgtaaacatgaacaccaacgaagtgctggccaatatcggtctggaactgatgggtcaccagaaaggtgaatatcagtacctgaacccgaacgaccatgttaacaaatgtcagtctactaacgacgcctacccgaccggtttccgtatcgcagtttactcttccctgattaaactggtagatgcgattaaccaactgcgtgaaggctttgaacgtaaagctgtcgaattccaggacatcctgaaaatgggtcgtacccagctgcaggacgcagtaccgatgaccctcggtcaggaattccgcgccttcagcatcttgctgaaagaagaagtgaaaaatatccaacgtaccgctgaactgctgctggaagttaaccttggcgcaacagcaatcggtactggtctgaacacgccgaaagagtactctccgctggcagtgaaaaaactggctgaagtcactggcttcccatgcgtaccggctgaagacctgatcgaagcgacctccgactgcggcgcttatgttatggttcacggcgcgctgaaacgcctggctgtgaagatgtccaaaatctgtaacgacctgcgcttgctctcttctggtccacgtgccggcctgaacgagatcaacctgccggaactgcaggcaggctcttccatcatgccagctaaagtaaacccggttgttccggaagtggttaaccaggtatgcttcaaagtcatcggtaacgacaccactgttaccatggcagcagaagcaggtcagctgcagttgaacgttatggagccagtcattggccaggccatgttcgaatccgttcacattctgaccaacgcttgctacaacctgctggaaaaatgcattaacggcatcactgctaacaaagaagtgtgcgaaggttacgtttacaactctatcggtatcgttacttacctgaacccgttcatcggtcaccacaacggtgacatcgtgggtaaaatctgtgccgaaaccggtaagagtgtacgtgaagtcgttctggaacgcggtctgttgactgaagcggaacttgacgatattttctccgtacagaatctgatgcacccggcttacaaagcaaaacgctatactgatgaaagcgaacagtaatcgtacagggtagtacaaataaagaaggcacgtcagatggcgtgccttttttcttgtgagcagtaacttaaaaataacaatttaatatcaacttgttaaaaaacaaggaaggctaatatgctagttgtagaactcatcatagttttgctggcgatcttcttgggcgccagattggggggaataggtattggttttgcaggcggattgggggtgctggttcttgccgctattggcgttaaacccggtaacatcccgttcgatgtcatttccattatcatggcggttatcgccgctatttctgccatgcaggttgctggcggtctggactatctggttcatcagacagaaaagctgctgcgccgtaacccgaaatacatcacgatcctcgcaccgatcgtgacctatttcctgacaatctttgctggtactggcaacatctctctggcgacactgccagttatcgctgaagttgcgaaggaacaaggcgttaaaccttgccgtccgctgtctactgcagtggtatccgcgcagattgcgatcaccgcatcgccaatctcagcggcagtggtttacatgtcttccgtaatggaaggtcatggcatcagctacctccatctgctctccgtggtcatcccgtccaccctgctggcggttctggtgatgtccttcctggtcactatgctgttcaactccaaactctctgacgatccgatttatcgcaagcgtctggaagagggcctggttgaactgcgcggtgaaaagcagattgaaatcaaatccggtgcaaaaacgtccgtctggctgttcctgctgggcgtagttggcgtggttatctatgcaatcatcaacagcccaagcatgggtctggttgaaaaaccgctgatgaacaccaccaacgcaatcctgatcatcatgctcagcgttgcaactctgaccaccgttatctgtaaagtcgataccgacaacattctcaactccagcaccttcaaagcaggtatgagcgcctgtatttgtatcctgggtgttgcgtggctgggcgatactttcgtttccaacaacatcgactggatcaaagataccgctggtgaagtgattcagggtcatccgtggctgctggccgtcatcttcttctttgcttctgctctgctgtactctcaggctgcaaccgcaaaagcactgatgccgatggctctggcactgaacgtttctccgctgaccgctgttgcttctttcgctgcggtgtctggtctgttcattctgccgacctacccgacactggttgctgcggtacagatggatgacacgggtactacccgtatcggtaaattcgtcttcaaccatccgttcttcatcccgggtactctgggcgttgccctggccgtttgcttcggcttcgtgctgggtagcttcatgctgtaatgacccatcgcggggcgttcacgccccgctttctttcccgccgactaacatcctttccccgtccgttgtatagtgacctctctcttgcagttccatctgttcttgcgaggtgtttatgcttgatgaaaaaagttcgaataccacgtctgtcgtggtgctatgtacggcaccggatgaagcgacagcccaggatttagccgccaaagtgctggcggaaaaactggcggcctgcgcgaccttgatccccggcgctacctctctctattactgggaaggtaagctggagcaagaatacgaagtgcagatgattttaaaaactaccgtatctcaccagcaggcgctgctggaatgcctgaagtctcatcatccatatcaaaccccggaacttctggttttacctgttacacacggagacacagattacctctcatggctcaacgcatctttacgctgatcctgctactttgcagcacttccgtttttgccggattattcgacgcgccgggacgttcacaatttgtccccgcggatcaagcctttgcttttgattttcagcaaaatcaacatgatctgaatctgacctggcagatcaaagacggttactacctctaccgtaaacagatccgcattacgccggaacacgcgaaaattgctgacgtgcagctgccgcaaggcgtctggcatgaagatgagttttacggcaaaagcgagatttaccgcgatcggctgacgcttcccgtaaccatcaaccaggcgagtgcgggagcaacgttaactgtcacctaccagggctgtgctgatgccggtttctgttatccgccagaaaccaaaaccgttccgttaagcgaagtggtcgctaacaacgaagcgtcacagcctgtgtctgttccgcagcaagagcagcccaccgcgcaattgcccttttccgcgctctgggcgttgttgatcggtattggtatcgcctttacgccatgcgtgctgccaatgtacccactgatttctggcatcgtgctgggcggtaaacagcggctttccactgccagagcattgttgctgacctttatttatgtgcaggggatggcgctgacttacacggcgctgggtctggtggttgccgccgcagggttacagttccaggcggcgctacagcacccatacgtgctcattggcctcgccatcgtctttaccttgctggcgatgtcaatgtttggcttgtttactctgcaactcccctcttcgctgcaaacacgtctcacgctgatgagcaatcgccaacagggcggctcacctggcggtgtgtttattatgggggcgattgccggactgatctgttcaccatgcaccactgcaccgcttagcgcgattctgctgtatatcgcccaaagcgggaacatgtggctgggcggcggcacgctttatctttatgcgctgggcatgggcctgccgctgatgctaattaccgtctttggtaaccgcttgctgccgaaaagcggcccgtggatggaacaagtcaaaaccgcgtttggttttgtgatcctcgcactgccggtcttcctgctggagcgagtgattggtgatatatggggattacgcttgtggtcggcgcttggtgtcgcattctttggctgggcctttatcaccagcctacaggccaaacgcggctggatgcgcgtggtgcaaataatcctgctggcagcggcattggttagcgtgcgcccacttcaggattgggcatttggtgaaacacataccgcgcaaactcagacgcatctcaactttacacaaatcaaaacagtagatgagttaaatcaggcgctcgttgaagccaaaggcaaaccagtgatgttagatctctatgccgactggtgcgtcgcctgtaaagagtttgagaaatacaccttcagcgacccgcaggtgcaaaaagcgttagcagatacggtcttacttcaggccaacgtcactgccaacgacgcacaagatgtggcgctgttaaagcatcttaatgtccttggcctaccgacaattctcttttttgacggacaaggccaggagcatccacaagcacgcgtcacgggctttatggatgctgaaaccttcagcgcacatttgcgcgatcgccaaccgtgaacgacacttgcagtgggaaagacggaggaaaatagcgtgcaacgtgaagatgtactgggagaagccctgaaattattagaattacaagggattgccaacaccacgctggagatggttgctgaacgtgtggattatccactggacgagctacgccgcttctggccagacaaagaggcaatcctctacgatgcgctgcgttatcttagccaacagatagatgtctggcgtcgtcagctgatgctggacgaaacgcaaaccgccgaacaaaagttgctggcacgttatcaggcgttatcggagtgcgttaaaaacaaccgctatccgggctgtctgtttatcgctgcctgtacgttttaccccgatcctggccaccctattcatcaactggccgatcagcaaaaaagcgcggcctacgatttcacccacgaactgttaaccacgctggaagttgacgatccggcgatggtagcaaagcagatggaactggtgctggaaggctgtttaagccgaatgctggtgaatcgtagccaggcggatgtcgacaccgcacatcggctggcggaagatatcctgcgcttcgcccgctgccgtcagggtggtgcactgacctgacagaaacacagaaaagaagcgatttgccgcaatcttaagcagttgaatcgcttttactgaaattaggttgacgagatgtgcagattacggtttaatgcgccccgttgcccggatagctcagtcggtagagcaggggattgaaatcataaactgcaccttcagatgtcagattatgtccaacatttggggtgcagttcattacgccgcatccggcatctttcctaacgccgatcgagagaaattgcccccggcccggtaattgccagcagcaggaatgcgccagcaatgctgatattcttccagaaattaatcatatttggcccaaccgcatcgccagtcatatcccagtaatgatgaccaatcaccgcagttcccagcgtgtagaaaataaacagcaccgccagcggacgggtgaaaaagccaagtatgattaatatcgcggcgggcacttccataactaccgcaataatcgctgccagcatcggcattggcgcgcccagcgaggccatatattggaccgtaccgtcaaagcccatcattttgggaaaaccaaaaataatgaaaattaagaccacggcgatacgggcaattaataataaaacggggcgggcagtgccaaaatcaaaataacgtagtgagttcataaccaatccctttgcaagatgatgtgatttaaacgtaatacacactctggtacctcgccacgcccaggcgttgagatattcgtttctggtataacggcataacgcagatggctgacaatgtgcttattgtttcctgccggatgcgacatgcacgccttatccgtctcacatgagtttgtcagttcaataaattgcgattttcacctgtttcatcgttcttttttacatgttgtgttgtgggacgctcttttttgtcatttcctgatatgcaggataaccgtcaggaagcaggctcgaatattcttatttttcaacttgcaccaacattcgattaaccccagactaacgcctcctgacgggagggactcatggttttgcaatccacgcgctggttggcgctcggctatttcacatacttttttagttacggcatttttctacctttctggagcgtctggcttaaagggattggtttaacgccagaaaccatcggcctgttattgggggcgggtctggttgcccgtttcctcgggagtttgctcatcgcgccccgcgtcagcgatccttcccgcctgatttccgccttgcgcgtgctggcactgctgacacttctctttgctgtcgccttctgggcgggggcgcacgtagcgtggctgatgctggtgatgattggctttaacctctttttctcaccgctggtaccgttgaccgatgcactggcgaatacgtggcaaaagcagttcccgcttgattacggcaaagtgagactgtggggctcggtggcgtttgtcattggctcggcgctgacgggcaaactggtcagtatgtttgattatcgggtgatcctcgcgctgttgacgttgggcgtggcatccatgctgctcggctttctcatccgtccgacgattcagccacaaggggcaagccgccagcaggagagcaccggctggtctgcgtggttggcgttggttcgccagaactggcgctttctggcctgcgtttgtttattgcagggggcacatgcggcctattacggttttagcgccatttactggcaggcagctggctactcggcctcggcggtggggtatttgtggtcgctgggcgtggtggcggaagtcattatctttgcgctgagtaataaacttttccgccgttgtagtgcacgcgatatgctgttgatctcggcgatttgcggcgtagtgcgctggggcattatgggagcaacgacggcgttgccgtggttgatagtggtgcaaattctgcattgcggtaccttcacggtctgccacctggctgccatgcgctatattgctgctcgccagggtagcgaagtcatccgtttacaggcggtttactctgccgtcgcgatgggcggcagtatcgccatcatgaccgttttcgccggtttcctgtatcaatatctcggccacggcgtgttctgggtgatggcgctggtggcgcttccggcaatgtttttgcgcccgaaagttgttccctcatgctgattcgagcattttgcggatctgctcctgttgatgtgttgtcaacgtcaggtccgtatagatcagcggtggtgaaaagagcggtaacggcatggtataaggcgcaataatcagtgccgcgccgcgcggagcgcctgtctgcaaaaatacctttaccgacatatgtttaatgttgagcggcagtaacgttagttcgcgtagctgctgctcaatctgcgcttctcgctcgctatcattcccggtcaatagaataatctgtttctcatgcaggtcgttttcctgcattagccaggcaccaaaaatcaccgcgaccagactgctttcctcatcagaaagatggacgccgtattcactttcaaatccggccagcgccgcgcgggtggtgcgcaccaggcgtggatacaggcgggcgaactcttccggcagagtgttatcaataccgatggcaaacaaactgcgatttaacgcctgggcgaggtgggtataaagctgatcgcataacccctgttcatcataaaaacgaacatttcccagctcacgaaaatggtttaccagacgtttgatagactgacgcagttgtctgtcccgctgatgcgcatcccgcagtggatcgggaacccgcaacatggaaaacagtagagccataaacagtggctcatcaggcggtacaggctggagtgcccgacgctgccagtggcgtccaatttcctgcgctacctgaaattcaaggcaggattccgcccagcgacgttggagcggattaaactgaggcgtaattccagcgtgatgttgcaacaaacaatattgcaaatacagacacaggaaatgaatatcgcgcgtttcaaagcgtttttgcagccgtcgagagcagagattcactaacgcttgtagattggtatcgtcgtaaaagttacgcgcaattccgcgccgcttcagttcactcttcagggcgggggtgaatcggctggtaataaatgacggacacagacggaaaccacgtcgtagccagtgaaataaacacaaacgttggttaagcactgtaccttcaacccggtagctgccgtcataaccagtagtcagtgtgagttgatgatagcgcaggatctcccgtcctgtttcgctgatatcaagactggcaatatcatcatccacaccattaagctcgctgaaagttgccgtggtggcggtcaaccccggctgaaagagcgtcagcaagatctggcagcggcgctggggagccgaaaggacagatggtggagcaagcgtaggcatcatctgtagatctcccataagcataattgataagaatagctaaagtttgctcagggaaatggcgaagggaatgctaatcatcagaaatgttggcaagcatcacagaatttttctcattttaaactgttctgaccagtggattagcatgtcttaaggtggttttgtgaatgattatcgtgctagcgatcatgggttagttctgcggattcaatgcgctaaggataaaatccaccatctgttcgcgataaacatcgccgtgacgatcggaaaaagcatcaatgtgttcgccatccgggattaggatcaaccgttttggctcttttgccaggctatacaacttttcgctgtgctgccatgggataacgtgatcagctttaccgtgaatgagtaaaagcgggatcgggctgacgctggcgatgtaattttcgccgctgtaactctcatcaagtaagtagccactgccggggagcatctggttggcgatggtcgcataagaggcaaaggtggagtcgaggatcaccgcacgtatgccttcacgatcaccctgaccaataacatccagaatattcgccccgccaatactctgcccgaacagcaccagccgttgtgggtttacatcactgcgatggcgcaccacattgatggcactttgcgtatcgtccagcaatccggcctgggacggcgtgccttttgatttaccaaacccgcgataatcaaacataaaaacgttgaaattacgctcgggtaaccaactgaccagcggccagtgggcggacatatttccggcattgccgtgagcatgaatgatggttgagatggcgttgtcagcagggcccgtcgaagaaggaataaaccagccttgcagacgagtaccgtccttagccgtaaattcgatggattccgccgaccaggggtcgggaccgtatattttatcgtcaggataatagaagaagttgatggcgacgcgcggcactaaataaacgcagaaggcaacaacaaagagaataaacagaattttgagaacgcgtttgttcactggcagcgccataatctttccttgcgacttctttatcatccattaatcggggaaagatggtgggagagtgacgaaagaaagtaaagcggtgaggaagtatttcggaatagcgcctgaaaggcgagggcgggtgagtgatatcacccgcctgagtcattaacgcttcagagcgtcgcttaactcgtcacgcatgttcgccagcatggctttaacaacgcgcgggttaccagcaacgatgttaccggtcagcatatagttatgaccaccggtgaagtcgctgacgatgccgcccgcttcacgaaccagcagctcgcctgccgcgaaatcccacgggcgcagaccgatttcaaagaaaccgtcaacacgacccgcagcgacgtaagacagatccagcgccgcagaaccggtacgacggaagtctgcacattcgttgaacagtttgccgacgatgttgatgtaggtagtggcgtactgttttgctttgaacgggaagccggtcgccagaatagtaccgtcgagatcgcgagcggtgctgccgcgcagacggtagccgttcagctgtgcgccctgaccgcgagtggcggtgaacagttcgttacgcataggatcgtataccacagcaacttcggtgcggcctttgatacgaacggcgatagataccgcgaagtgcggcagacgtttgataaagttggtagtgccatccagtggatcgataacccattgaacatcctgatcggtaccttcaagttcaccgctttcttcggtgatgatggtgtgctgtgggtaagatttacgaatcgtgtcgataatcaccgcttcggcagctttatctacgttggtcacgaaatcgttactgcctttctggctcgcttctacagcgtccggggtttcatagtttttggcaattaaattacccgccttgcgcgctgcgcgcacggcgatgttcagcatcggatgcatcggtctctctcactggatgttaaagaacgggaaaacggcgcagagtatagcagcgagatcggcatctgtcttcgttttatgataagatgcgtgaataatctttagatgaagaaagacaatgctgcaaaatattcgaattgtgctggtggagacgtcacacaccggcaatatgggttctgttgcccgtgccatgaaaacaatgggattaaccaatctgtggctggttaatccactagtgaaaccagactcccaggcgattgccctggcagcaggggccagcgatgtgattggtaatgctcacatcgtcgatacgctcgacgaagcgttagccggttgtagtctggtggtgggcaccagcgctcgctcccgcacgctgccgtggccgatactcgacccgcgcgaatgcggtctgaaaagcgtcgctgaagcggcaaataccccggtggcgctggtgtttggtcgcgagcgcgtcggcttgaccaatgaagagttgcagaaatgccattatcatgtcgcgattgcggctaacccggaatacagttcgctgaacctggcgatggcggttcaggttattgcctatgaagtgcgcatggcctggctggcaactcaggaaaatggcgagcaggtcgagcatgaagagacgccgtatccgctggtcgatgatctggagcgtttttatggtcatctggagcaaacgctgctggcaaccggttttatccgtgaaaaccatccggggcaggtgatgaataaattgcgccgtctgtttacccgtgcacgcccggaaagccaggaattgaatatcctgcgcgggattctggcttctattgagcagcagaataaaggtaacaaggccgaataacagtggttgcctgatgcgatgcttaacgcgtcttatcaggcctgtaagtgcacggaatcccaggtcggataaggtgttcacaccgcatccgacaacaggtacaaacgccacgataaaaaatggcactgaaggttaaatacccgactaaatcagtcaagtaaatagttgaccaatttactcgggaatgtcagacttgaccctgctatgcaatacccccacttttacaataaaaaaccccgggcaggggcgagtttgaggtgaagtaagacatgagactgacatctaaagggcgctatgccgtgaccgcaatgcttgacgttgcgctcaactctgaagcgggcccggtaccgttggctgatatttccgaacgtcagggaatttccctttcttatctggaacaactgttttcccgtctgcgtaaaaatggtctggtttccagcgtacgtggaccaggcggtggttatctgttaggcaaagatgccagcagcatcgccgttggcgaggtgattagcgccgttgacgaatctgtagatgccacccgttgtcagggtaaaggcggctgccagggcggcgataaatgcctgacccacgcgctgtggcgtgatttgagcgaccgtcttaccggttttctcaataacattactttaggcgaactggttaataaccaggaagtgctggatgtgtctggtcgtcagcatactcacgacgcgccacgcacccgcacacaagacgcgatcgacgttaagttacgcgcttaataaaaagaattcagaatcaggccggagtgctaaatactccgtaaacacggtcgtacatccagccggtagcctgattccttgcattgagtgatgtacggagtttatagagcaatgaaattaccgatttatctcgactactccgcaaccacgccggtggacccgcgtgttgccgagaaaatgatgcagtttatgacgatggacggaacctttggtaacccggcctcccgttctcaccgtttcggctggcaggctgaagaagcggtagatatcgcccgtaatcagattgccgatctggtcggcgctgatccgcgtgaaatcgtctttacctctggtgcaaccgaatctgacaacctggcgatcaaaggtgcagccaacttttatcagaaaaaaggcaagcacatcatcaccagtaaaaccgaacataaagcggtactggatacctgccgtcagctggagcgcgaaggttttgaagtcacttacctggcaccgcagcgtaatggcattatcgacctgaaagaactcgaagcagcgatgcgtgacgacaccatccttgtttccatcatgcacgtaaataacgaaatcggcgtggtgcaggatatcgcggctatcggcgaaatgtgccgtgctcgtggcattatctatcacgttgatgcaacccagagcgtgggcaaactgcctatcgacctgagccagttgaaagttgacctgatgtctttctccggtcacaaaatctatggcccgaaaggtattggtgcgctgtatgtgcgtcgtaaaccgcgcgtacgtatcgaagcacaaatgcatggcggcggtcacgagcgcggtatgcgttccggcactctgcctgttcaccagatcgtcggtatgggcgaagcctatcgcatcgcaaaagaagagatggcgaccgagatggaacgtctgcgcggcctgcgtaaccgtctgtggaacggcatcaaagatatcgaagaagtttacctgaacggtgacctggaacacggtgcgccgaacattctcaacgtcagcttcaactacgttgaaggtgagtcgctgattatggcgctgaaagacctcgcggtttcttcaggttccgcctgtacgtcagcaagcctcgaaccgtcctacgtgctgcgcgcgctggggctgaacgacgagctggcacatagctctatccgtttctctttaggtcgttttactactgaagaagagatcgactacaccatcgagttagttcgtaaatccatcggtcgtctgcgtgacctttctccgctgtgggaaatgtacaagcagggcgtggatctgaacagcatcgaatgggctcatcattaatcggtatcggaatcaggagaatttataatggcttacagcgaaaaagttatcgaccattacgagaatccgcgtaacgtgggttcctttgacaacaacgacgagaacgtcggcagcggcatggtgggtgcaccggcctgtggcgacgtgatgaagttgcagattaaagtcaacgatgaaggtatcattgaagacgcgcgttttaaaacttacggctgcggttccgctatcgcttccagctccctggtcaccgaatgggtgaaagggaagtctctcgacgaagcacaggcgatcaaaaacaccgatattgctgaagaacttgaactgccgccggtgaaaattcactgttctattctggcagaagacgcgatcaaagccgccattgcggactataaaagcaaacgtgaagcaaaataagagttgaggtttggttatgtcgattacactgagcgacagtgcagcagcgcgagtaaatacctttctggctaaccgcggtaaagggtttggcctgcgtctgggcgtgagaacctccgggtgttcaggtatggcttatgtactggaatttgttgacgaaccgacgccggaagacatcgtgtttgaagacaaaggcgtgaaagtcgtggtcgatggcaaaagcctgcaatttctggacggtacgcagctggacttcgtcaaagaaggccttaacgaagggtttaaattcaccaacccgaacgtcaaagatgagtgtggttgcggcgaaagcttccacgtttgatgcgcataccgataaccccaccgtggtcgcctgcgcgtggggtttgttttacctgattcgccgttatcgcggcggatcgcagccctgagaatgttatggattacttcaccctctttggcttgcctgcccgttatcaactcgatacccaggcgctgagcctgcgttttcaggatctacaacgtcagtatcatcctgataaattcgccagcggaagccaggcggaacaactcgccgccgtacagcaatccgcgaccattaaccaggcctggcaaacgctgcgtcatccgttaatgcgcgcggaatatttgctttctttgcacggttttgatctcgccagcgagcagcatactgtgcgcgacaccgcgttcctgatggaacagctggaactgcgcgaagaactggacgagatcgaacaggcgaaagatgaagcgcggctggaaagctttatcaaacgtgtgaaaaagatgtttgatacccgccatcagttgatggttgaacagttagacaacgagacgtgggacgcggcggcggataccgtgcgtaagctgcgttttctcgataaactgcggagcagtgccgaacaactcgaagaaaaactgctcgatttttaatttctggaagctaaacatggccttattacaaattagtgaacctggtttgagtgctgcgccgcatcagcgtcgcctggcggccggtattgacctgggcacaaccaactcgctggtggcaacagtgcgcagcggtcaggccgaaacgttagctgaccatgaaggccgtcacctgctgccatctgttgttcactatcaacagcaagggcattcggtgggttatgacgcgcgtactaacgcagcgctcgacaccgccaacaccattagttctgttaaacgcctgatggggcgctcgctggctgatatccagcaacgctatccgcatctgccttatcaattccaggccagcgaaaatggcctgccgatgattgaaacggcggcggggctgctgaacccggtgcgcgtttctgcggacatcctcaaagcactggcggcgcgggcaactgaagccctggcaggcgagctggatggtgtcgttatcaccgttccggcgtactttgacgatgcccagcgtcagggcaccaaagacgcggcgcgtctggcggggctgcatgttctgcgcttacttaatgaaccgaccgctgcggctattgcctacgggctggattccggccaggaaggcgtgatcgctgtttatgacctcggcggcgggacgtttgatatttccattctgcgcttaagtcgcggcgtgtttgaagtgctggcgaccggtggtgattccgcgctcggcggcgatgatttcgaccatctgctggcggattacattcgcgagcaggcgggcattcctgatcgtagcgataaccgcgttcagcgtgaactgctcgatgctgccattgcggccaaaatcgcgctgagcgatgcggactctgtgaccgttaacgttgcgggctggcagggcgaaatcagccgtgaacaattcaatgaactgatcgcgccactggtaaaacgaaccttactggcttgtcgtcgcgcgctgaaagatgcgggcgtagaagctgatgaagtgctggaagtggtgatggtgggcggttctactcgcgtgccgctggtgcgtgaacgagtaggcgaatttttcggtcgtccaccgctgacttctatcgacccggataaagtcgtcgctattggcgcggcgattcaggcggatattctggtgggtaacaagccggacagcgaaatgctgttgctggatgtgatcccgctgtcgctgggcctcgaaacgatgggcggcctggtggagaaagtgattccgcgtaataccacgattccggtggctcgcgcccaggatttcaccacctttaaagatggtcagacggcgatgtctatccatgtaatgcagggtgagcgtgaactggtgcaggactgccgctcgctggtgcgttttgcactgcgtggtatcccggcgctaccggctggcggcgcgcatattcgcgtgacgttccaggtcgatgccgacggtcttttgagcgtgacggcgatggagaaatccaccggcgttgaggcgtctattcaggtcaaaccttcttatggcctgaccgacagcgaaatcgcctcgatgattaaagactcaatgagctatgccgagcaggacgtaaaagcccgaatgctggcagaacaaaaagtagaagcggcgcgtgtgctggaaagtctgcacggcgcgctggctgctgatgccgcgctgttaagcgccgcagagcgtcaggtcattgacgatgctgccgctcacctgagtgaagtggcgcagggcgatgatgttgacgccatcgaacaagcgattaaaaacgtagacaaacaaacccaggatttcgccgctcgccgcatggaccagtcggttcgtcgtgcgctgaaaggccattccgtggacgaggtttaatatgccaaagattgttattttgcctcatcaggatctctgccctgatggcgctgttctggaagcgaatagtggtgaaaccattctcgacgttgcgctgcgtaacggtatcgagattgaacacgcctgtgaaaaatcctgtgcttgcaccacctgccactgcatcgttcgtgaaggttttgactcgctgccggaaagctcagagcaggaagacgacatgctggacaaagcctggggactggagccggaaagccgtttaagctgccaggcgcgcgttaccgacgaagatttagtggtcgaaatcccgcgttacactatcaaccatgcgcgtgagcattaacagaggttagtatgggacttaagtggacggatagccgcgaaattggcgaagcactgtacgatgcgtatcccgatcttgatccgaaaacggttcgattcaccgatatgcatcagtggatttgcgatctggaagatttcgacgacgacccgcaggcatccaacgagaaaatcctcgaagcgattttgttggtctggcttgacgaggccgagtaaatgaacgggctgcctgggggtagcccgttttgctgttaaacgaataaggataactaaaatgacagaagcgatgaagattaccctctctccccaacctgccgacgcacgttggggagaaaaagcgacttacagcattaataatgatggcattaccctgcatttgaacggggcagacgatctggggttgatccagcgtgcggcgcgcaagattgacggtctgggcatcaagcatgttcagttaagcggtgaaggctgggatgcggatcgctgctgggcattctggcaaggttacaaagccccgaaaggcatacgtaaagtggagtggccggatctggacgatgcccagcgtcaggaactggataaccgcctgatgatcatcgactgggtgcgtgacaccatcaacgcaccggcagaagagctggggccatcgcaactggcacagcgtgctgttgatctgatcagcaacgtcgcaggggatcgtgtgacttaccggatcaccaaaggcgaagatctgcgtgagcaaggttatatggggctgcacacggtcgggcgcggttcagaacgttctccggtattgctggcgctggattacaacccaactggcgataaagaagcgccagtgtacgcgtgcctggttggtaaaggcatcacttttgattccggcggctacagcatcaaacagactgcgtttatggactcgatgaagtcggacatgggcggcgcggcaacggttaccggggcgctggcatttgccattacgcgcggactgaacaagcgcgtgaagctgttcctctgttgtgcggataacctgatcagcggcaacgcgttcaaactgggcgatattattacctatcgcaacggtaaaaaagttgaagtgatgaacaccgatgccgaagggcgtctggtgctggccgatggcctgattgatgccagtgcgcagaaaccggaactgatcattgatgcggcgaccctcaccggggcggcgaaaaccgcgctgggtaatgattatcacgcgctgttcagttttgacgatgcgcttgccggtcgcttgttggcgagtgccgcgcaggagaatgaaccgttctggcgtctgccgctggcggagttccaccgcaatcaattgccgtctaactttgccgaactgaacaacaccggaagcgcggcgtatccggcaggcgcgagcacagcggcgggtttcctgtcgcactttgttgagaactatcagcaaggttggctgcatatcgactgctcggcgacttaccgtaaagcgccggttgaacagtggtctgcgggtgctacgggacttggtgtgcgcacgattgctaatctgttaacggcgtaaactaatatgccggatgcggcgtaaatgccttatccggcctacaaagtattgcaaattcaatatattgcggttcccttgtaggcctgataagcgtagcgcatcaggcacttacgccccgaacgttgaatgaattatggttcttatgtccgaaacaaaaaacgaacttgaagacctgctggaaaaagcagcaaccgaaccggcgcaccgcccggcctttttccgtactctactggaatccaccgtctgggtgcctggtacggcggcacagggcgaggctgtggttgaagatagcgcacttgatttacagcactgggaaaaagaagacggcaccagcgtcattcctttttttacctcgttagaagcacttcaacaggcggttgaagacgaacaggcatttgtcgtaatgcccgttcgcacattgtttgagatgacccttggcgaaacgctcttccttaatgccaaactgccaaccggtaaagagtttatgccgcgtgaaatcagtttgttgattggtgaagaagggaatccgctgagtagccaggaagtactggaaggcggtgaatcgctgatattatcggaggtcgcagagccgccagcgcaaatgattgattcacttaccaccttatttaaaaccattaagccggtgaagcgtgcttttatttgttcaattaaagagaacgaagaggcacagcctaatttacttattggcattgaagccgatggtgatatcgaagaaattattcaggcggcgggaagtgtagcgaccgatacattacctggcgatgaacccatcgatatttgtcaggtgaaaaaaggggaaaaaggtattagccactttattaccgaacatattgcgccattctatgaacgtcgctggggtggttttttgcgtgactttaaacagaaccggataatttaaaacatgccgccccaaagggcggcattcgggcttacttgctgttctgaaggttgttaaccaccagtaaattgtcgccgaagagacttcggttattatttacctcggttaacagcgcaccagaaacaataagtacgatacaaaagcaccgtatcttcattgtgcggtccatgcgaagaccgcatcacgacagcaccactggcgatattgccgcgatagcaagcgctgagacgcgcttgccctaacggtcgcggaacatcctttccttaagccagcgcccgcttgcgagacggcggaaagggccgcagtggataatacactaacagaacaataataactctcttttacttgacaaaaagagagttactggcgagtattgtgtccgctgagacgcgcttgcattactacggtaatacaacctgctggaaaggccgcgaaccagaccagcaataaaaaaccgccagattcggcggttttttattgcctgtaaaaagcttattttacgggctcaaccggtaaatctgcccgtgcgccccattcactccatgcgccgtcgtacagtttcacgtttgtcacatccagcgtcgcaagtgccaacaaaaccacggctgctgttacaccagaaccgcagctgacgataattggtttgtcgtagctgacaccgcgaccaaaaaatatcgcatccagttcatcggtcgtttttagttcgccttcacgtaccagttccgtccacggaacgttcaatgcaccgggaatatgtccgcgacgtaaacctgggcgaggttcatcaacttctgcgttaaaacgtgtagccgggcgggcatcaataatttgcgccgtattttcatggcttgccaataatacatcggttactttcaccacggcttcaggattaaacgcggcgttaaactctccttccggcagctctactgcgccttcctctaatagcagatcatcacgctgccagcctgcaagtccaccacccagaatcgacactttctctacaccaaaggtgcgcagcatccaccatgctcgtggggctgagaaaagattaccttcgtcatagacaatcaggtgcttatcctggttaacgcctaattcacgcatcgccacggcgaacgtttccgggcgcggcagcatgtgcggaagcggggaagtgtgatcagaaagcgcttcgatatcaaaaaacactgcgcctggaatatgtccattcagatactcctgagcaacgttacgatcttcctgtccaggcgacgccatgcgggcatcgataatctgaatttccgggtcatcaatatgttcggcgagccagtcggctcctacaaaccatgtcgtggacataggcatctccatttttgccggggttaggctaaattgtcggatgtttagtgaaaagcgacaagcaaaagaggctgatttggctgtctgagccacaattctcactaaaattcggattgtatgggcgtgatactgaattacataacgtaaattctcacgcataataattattcgacgttgctaacgggccattgtggcagggatgaaaaatgaaaaagttacgcgtagccgcctgcatgctaatgctggcgctggcagggtgcgacaacaacgataacgcgccaacagcggtgaaaaaagatgcgccttctgaagttactaaagcggcctcttcagaaaacgtgagttcagcaaaactttccgcgccggagcgacaaaaactggcccaacagagtgccggtaaggcgctgacattgctggatctctctgaagttcaactcgatggcgcagccacgctggtgctgacgttctccatccctctcgacccggatcaggatttctcacgcgttattcatgtcgtcgataaaaaaagcggcaaagtggatggtgcctgggagctgtcacataatcttaaagagctgcgtttacgccacctcgaaccgaaacgtgatttgatcgtcactattggcaaggaggtcaaagcgctcaataacgcaacctttagtaaagatgacgaaaaaactataactacccgcgatatccaacccagcgtcggttttgccagtcgtggttcgttgcttcctggtaaggtcgttgaagggctgccggtaatggcgcttaacgttaacaatgtcgatgttaacttcttccgtgtgaaaccagaatcactgcccgctttcattagccagtgggaataccgcaattcgctggcgaactggcagtcagacaaactgctgcagatggcggatctggtctacactggacggtttgatctcaatcctgcgcgtaacacccgtgaaaaattattgctgccgctgggcgatatcaaaccgcttcagcaggcaggcgtgtatctggctgtgatgaatcaggctggacgttacgattacagtaatcccgcgacgctgtttacgttaagtgatatcggcgtttcagctcaccgttatcacaatcgtctggatatctttacccaaagtctggaaaacggcgcggcccagcaaggaatagaagtctctttattaaatgagaaagggcagactctgactcaggcaaccagtgatgctcaggggcatgtgcagctggaaaatgataaaaacgcggcattactgctggcgcgtaaagacggtcagacaacgctactcgatttaaaactcccggcgctggacttagcggaatttaacattgctggcgcgccgggctatagcaaacagtttttcatgtttggcccgcgcgatctttatcgcccgggtgaaacggtcatcctcaatggtttgctgcgtgatgcagacggtaaagcattgcccgatcaacccatcaagttagacgtgattaaacccgacgggcaggtactcaggagcgtcgttagtcagccggagaatggcctctaccactttacctggccactcgatagcaatgcggcaaccggtatgtggcatattcgcgctaacacgggcgataaccagtaccggatgtgggatttccacgtcgaagattttatgccagagcgcatggcgctgaatctgaccggtgagaaaaccccgctaacgccgaaagatgaagtgaaattctccgtggtggggtactacctgtatggtgcgcctgctaatggtaatattttgcaagggcaacttttcctgcgcccactgcgtgaagctgtgtcagccttacctggttttgaattcggagatatagctgccgaaaatctttcccgcacgctggatgaagttcagttgacgctggatgataaagggcgcggcgaagtttctacagaaagccagtggaaggaaacgcattccccattacaggttattttccagggtagtttgctggaatcgggcggtcgcccggtgacgcgccgtgctgagcaggctatctggcctgccgatgcattgccggggatccgtccgcagttcgcctcgaaatcggtttacgattatcgcaccgacagcacggtgaaacagcccattgttgatgaaggcagtaacgccgcttttgacatcgtttatagcgatgcgcaaggcgtgaaaaaagccgtgtcgggcttgcaggtgcgcctgattcgcgaacgccgcgattactactggaactggtcggaatatgaaggctggcagtcacagtttgatcaaaaagatctgatcgaaaatgaacaaactctggatctgaaagcggacgaaaccggtaaggtcagtttcccggtagagtggggcgcttatcgtctggaagttaaagcgccgaatgaagcggtcagtagtgtgcgtttctgggctggttatagctggcaggataacagcgacgggggtggtgcagtgcgacccgaccgtgtcacgctgaaactggataaagccagctatcgccctggcgataccattaagttgcatattgccgcgccaacggcgggtaaaggttatgcgatggtcgagtccagtgaagggccgctgtggtggcaagagattgatgttccggctcaagggctggatctgacgattccggtcgataaaacctggaatcgtcatgatctgtatttaagtacgctggtggtacgtcctggcgataaatctcgctccgcgacgccaaaacgcgcggttggggtgttgcatctgccgcttggtgatgaaaaccgtcgcctcgatctggcgctggaaacccccaccaaaatgcgccccaatcagccattaaccgtgaaaattaaagccagcaataaaaatggtgagatgccaaaacaggtgaatgtgctggtgtctgccgttgatagcggtgtgctgaatattactgattatgtcacgccagatccgtggcaggcattctttggtcagaaacgctatggcgcagacatttacgatatttacggtcaggtcattgaaggtcaggggcgtctggcagctctgcgttttggtggtgatggtgatgagctgaaacgtggtggtaaaccgccggtcaatcacgtcaatattgtcgcgcagcagccgctgccggtaacgctcaatgaacagggcgaaggctcggttacactgccaattggcgattttaacggtgaattgcgcgtcatggcgcaagcctggacggcagatgacttcggaagcaacgaaagcaaagtgattgttgccgcaccggtgattgctgaactgaacatgccgcgctttatggcgagtggcgatacctcgcgcctgacgctggatatcactaatcttaccgataaaccgcaaaaacttaatgttgctctgaccgccagtggcttgcttgaactggtgagtaattcccccgcacctgttgaattagcgccaggggtgcgtactacgctgtttatcccggtgcgtgcattgccgggttatggcgatggagacattcaggccaccattagcgggttagcgttaccgggggaaaccgttgccgatcagcataagcagtggaaaatcggcgtccgtccggcattcccggcacaaacggtcaattacggtacggcgttacagcctggtgaaacctgggcgctcccggctgatggattgcaaaacttctcgcctgttacgctggaagggcaattgttgttgagcggcaaaccaccgctgaacatcgcacgttatatcaaagagttaaaagcgtatccgtacggctgtctcgagcaaaccaccagcggcctgttcccgtcactttataccaatgcagcccaactgcaggcgttgggcatcaaaggcgacagtgatgagaaacgccgtgcatcggtcgatatcggcatttcccgtttgctgcaaatgcaacgtgataacggcggctttgcgctgtgggataaaaacggtgacgaagagtactggctgacggcttacgtgatggatttcctggtccgcgcaggcgaacagggttacagcgtgccgacagacgccattaaccggggtaatgagcgtctgctgcgctatttacaagatccgggcatgatatcgatcccgtacgctgataatctcaaagccagtaaattcgccgtacagtcttacgctgcgctggtgttggcccgtcagcaaaaagcaccactgggtgcgctgcgtgaaatctgggagcatcgtgcagatgccgcttctggtttaccgctgctgcaacttggcgttgcgctgaaaatcatgggtgatgcgacgcgtggtgaagaagcgattgcgctggcgctgaaaacgccgcgtaatagtgatgagcggatatggctgggtgattacggtagtccactgcgcgacagcgcgttgatgctctcattgctggaagagaacaaactgctacccgatgagcagtactccctgttaaacacactttcgcagcaggcgttcggtgaacgctggctatcgacgcaggaaagtaacgcgttgttcctggctgcccgtactcttcaggatttaccgggcaaatggcaggcgcaaaccactttctctgctgagccgctgacaggcgagaaagcgcaaaccagcaatctgaatagcgatcaacttgccaccttgcaggtgaccaacagtggcgatcagccgttatggctgcgtgtggatgccagcggttatccgcaatccgcacctttaccggcgagcaatgtgctgcaaattgagcgtcatattctgggtactgacggtaagagcaaatcgctggactcgttacgtagcggcgatctggtgctggtgtggttgcaggttaaagccagtaacagtgtaccggatgcgttagtcgtggatctgttgcctgcggggctggaactggaaaaccagaatctggcgaacggcagcgccagcctggagcaaagtggtggtgaagtgcagaacttgctgaaccagatgcagcaggcgagcattaagcacatagagttccgtgacgatcgctttgtggcggcggttgccgttgatgaatatcaaccggtaacgctggtgtatctggcgcgggcggtgacgccgggaacgtatcaggtgccgcagcctatggtggaatcaatgtatgttcctcaatggcgggcgactggtgcggctgacgatctgttgatagtcagaccgtaaatgcctcgcctgttaaccaaacgcggctgctggataatgctggcagccgcgccttttatcatcattctggcagcatgggcagcagataaactctggcctctgccattgcaagaagtgaatcctgcacgcgtggtggtggcgcaggatggtacgccactctggcgtttcgccgatgctgacggcatctggcgttatccggtaacaatcgaagatgtttctccacgttaccttgaagcgctgatcaattatgaagatcgctggttctggaagcatccgggggtgaatccgttctcggtggcgcgtgcagcctggcaagatctcacgtcgggtcgggtcatttccggcggcagcacgctcaccatgcaggtggcgcgcctgcttgatcctcaccccaaaacgtttggcggcaaaattcgccagctctggcgcgcgttgcaactggaatggcatctgtctaaacgtgaaattctgaccttgtatcttaaccgtgccccgtttggcggtacgttgcaggggattggtgcggcaagttgggcttacctcgggaaatcgcctgcgaatttaagctattccgaggcggcaatgctggcggttttgccgcaagcgcccagccgtcttcgcccggatcgttggccggagcgtgccgaagccgcgcgtaataaagtgctcgaacggatggccgtgcaaggtgtgtggtcccatgagcgggtaaaagagtcaagggaagaacccatctggctggcaccccgacaaatgccgcaactggcaccgctgttttcgcgcatgatgctcggtaaaagcaaaagcgacaaaatcgttactacgctggatgccggtcttcaacgacgtctggaagaactggcgcaaaactggaaaggacgattaccaccgcgcagctcactggcgatgatcgtggttgatcataccgatatgcgtgttcgcggctgggtgggttcggttgatctcaacgatgattcacgctttggtcatgttgatatggtcaatgcgatccgatcgccaggatcggtgctcaaaccgtttgtttacggtctggcgctggatgaaggcttgatccacccggcatctctgttgcaagacgtcccccggcgtaccggtgattaccgacctggcaactttgacagcggttttcatgggccgatcagcatgagcgaggcgctggtgcgctcgctgaatttaccagctgtgcaggtgctggaagcctatggaccgaaacggtttgcggcaaaattacgcaatgttggattgccgttgtatctgcccaacggtgctgcgccgaatctttcgctcattctcggcggcgctggtgcaaaactggaagatatggcggcggcctataccgcgtttgctcgccacggcaaggcaggtaaattgcgcttacagcctgacgatccgctgcttgaacggcctttaatgtcgtcgggggctgcgtggatcattcgccggattatggctgatgaagcgcaacccttgccggatggtgccttgccgcgcgtcgccccactggcatggaaaacgggcaccagctatggctatcgtgatgcctgggcgattggggttaacgctcgctatgtcattgggatctggactggcagaccggacggcacgcccgttgttggtcagtttggctttgccagtgccataccgctgttgaatcaggttaataatatcttactgtcgcgcagtgtgaattttccggaagacccacgtcctgactctgtaagtcgtggcgttatctgctggccgggcggacagtctttgccggaaggtgacggtaactgtcgccgccgcctggcaacctggctgctggacgggagccagccgccaactctattactgccggagcaggaaggcattaatggcattcgtttccccatctggctggatgaaaacggcaaacgtgttgccgctgattgccctcaggcgcgacaagaaatgataaatgtctggccgctaccgctggaaccctggctgcccgcatcagaacgtcgcgctgtgcgcttgccaccggcctcgacaatttgcccgccatacggtcacgatgcacaactcccgctgcagctaacaggtgtgcgcgatggcgcgattattaaacgtttaccgggcgcagcggcagcgactttgccgttgcaatcaagtggaggagcaggtgaacgctggtggtttctgaacggcgaaccgttaactgaacgtgggcgcaacgtgaccctgcatttgacggataaaggcgattatcaattgctggtgatggatgacgtggggcaaatagcgacagtgaaatttgtcatgcaatagtctattttgtccctgattgttgcttaaactgggtttattttaaaaaaatgttaccttcatcaatagtcaacggctctgttgctcattataatccgcgccatctcgtacgctggtacagacaacaacagaacaatttacagaggtaaaaatggctattgaacgtactttttccatcatcaaaccgaacgcggtagcaaaaaacgtgattggtagtatctttgcgcgctttgaagctgcagggttcaaaattgtcggcaccaaaatgctgcacctgaccgttgaacaggctcgtggcttttatgctgaacacgatggaaaaccgttctttgatggtctggttgaattcatgacttctggcccgatcgttgtttccgtgctggaaggtgaaaatgctgttcagcgtcaccgcgatctgctgggcgcgaccaatccggcaaacgcactggccggtactctgcgtgctgattacgctgacagcctgaccgaaaatggtacccacggttctgattccgtcgagtctgccgctcgcgaaatcgcttatttcttcggcgaaggcgaagtgtgcccgcgcacccgttaataatttcgtaaatgccgcgtgcaaacgtggcatccgtgcgccagaatttgtacaatgcagcgcccccggacgagcagccgctcaccggggcgtttcttttttcaaccctccaggggccataacgtgtaataacgaggccggaatagcatatgtctgaacaattagtcacacctgaaaacgtcaccacgaaagatggaaaaatcaacctgctggatctcaaccgtcagcagatgcgggagttttttaaagatttaggtgaaaaacccttccgcgccgatcaggtgatgaagtggatgtatcactattgctgcgacaactttgatgagatgaccgacatcaataaagtgttgcgcggcaaactgaaagaggtggcggaaatccgtgcaccggaagtggttgaagaacagcgttcatctgacggcaccattaaatgggcgatcgccgttggcgatcagcgcgttgaaacggtgtatatcccggaagacgaccgtgccacgctctgcgtctcttcgcaggtggggtgtgcgctggagtgtaaattctgttccaccgcccagcagggctttaaccgcaacctgcgggtatcggaaattatcggccaggtgtggcgtgcggcgaaaattgtcggcgcagcaaaagtcaccggtcagcgcccaatcactaacgtagtgatgatgggtatgggcgagccgctgctcaacctgaacaacgtcgttccggcgatggaaatcatgcttgatgatttcggttttggcctgtcaaaacgtcgcgtcacgctttccacttccggtgtggttccggcgctggataaactgggcgatatgatcgacgtagcgctggcaatttccctgcacgcgccgaacgacgaaattcgtgacgaaattgtgccgatcaacaaaaagtacaatatcgaaacgttccttgcggcggtgcgccgttatctggagaaatccaacgccaatcagggccgagtcactattgaatacgtgatgcttgaccacgttaacgacggcactgaacacgcgcaccaactggcagaactgctgaaagatacgccgtgtaagatcaacctgatcccgtggaacccgttcccgggcgcgccgtatggacgcagttcgaacagccgtatcgaccgtttctcaaaagtgctgatgagctacggtttcaccactattgtgcgtaaaactcgtggtgatgatatcgatgctgcttgtggtcagttggcgggcgatgttatcgaccgtacgaaacgtactctgcgtaagcggatgcagggtgaagccatcgacattaaagcggtctgatagccattacgccacggttactttatgtaccgtggcgtaatcttttatgaatgaagtattaagttgcaattgtctggtcaatattaacggtgcgtttttgctgactttaaggcagtatgtaacgatgcaacagtaagttagccttagcgaatgtgggctttgtcacgagcacacagacggtcttatactgtatgataacggttaacttaacggatgtttcgcggtgtgggtgggcatgatggttcaccggcatctcaattctcatttaaacgtacctgcagcgaatgaatactgaagccacgcacgaccaaaatgaagcacttactaccggcgctcgcctgcgtaatgctcgcgaacaactaggacttagtcaacaggccgttgccgagcgactttgcctgaaggtttccacggtacgcgacattgaagaagataaggcacccgccgatcttgcttcaacattcctgcgcggatatatccgctcttatgcgcgtctggtacatattccagaagaagaactgctgccagggctggaaaagcaggctccactacgggctgcaaaagttgcgccgatgcagagtttttccctcggtaaacgccgcaaaaaacgtgacggctggctgatgaccttcacctggctggtgttgtttgtggttattggcctgagcggtgcctggtggtggcaagaccacaaagctcagcaggaagagatcaccactatggccgatcaatcttctgcggaactgaataataatcaaagccagagtgtaccgttagatacgtcgacaaccacagatcaggctatggcgaccacgccgacatcacctgtggataccaccgcaaccaacacgcaaacacctgccgtaactgcgccagcaccagctgttgatccgcaacaaaatgcggttgttccaccttcgcaggcaaatgttgataccgctgcgactccggcaccagcggcaacaacaacaccagatggcgctgcgccgttgccaaccgatcaggctggcgtgaccacgccggcggttgacccgaatgcgctggtgatgaactttactgccgattgctggctggaagtcaccgatgctaccggtaaaaaactgtttagcggtatgcagcgtaaagacggtaatttgaacttaaccggccaggcaccgtacaaactgaaaattggtgcgccagccgcagtacagatccagtatcaagggaaacctgtcgatctgagtcgttttatcagaactaaccaggttgcgcgtctgaccctcaatgccgaacaatcaccggcgcagtaacagacgggtaacgcgggagatttttcatgcataaccaggctccaattcaacgtagaaaatcaacacgtatttacgttgggaatgtgccgattggcgatggtgctcccatcgccgtacagtccatgaccaatacgcgtacgacagacgtcgaagcaacggtcaatcaaatcaaggcgctggaacgtgttggcgctgatatcgtccgtgtctccgtaccgacgatggacgcggcagaagcgttcaaactcatcaaacagcaggttaacgtgccgctggtggctgacatccacttcgactatcgcattgcgctgaaagtagcggaatacggcgtcgattgtctgcgtattaaccctggcaatatcggtaatgaagagcgtattcgcatggtggttgactgtgcgcgcgataaaaacattccgatccgtattggcgttaatgccggatcgttggaaaaagatctgcaagaaaagtatggcgaaccgacgccgcaggcgttgctggaatctgccatgcgtcatgttgatcatctcgatcgcctgaacttcgatcagttcaaagtcagcgtgaaagcgtctgacgtcttcctcgctgttgagtcttatcgtttgctggcaaaacaaatcgatcagccgctgcatctggggatcaccgaagccggtggtgcgcgtagcggggcagtaaaatccgctattggtttaggtctgctgctgtctgaaggcatcggcgacacgctgcgcgtatcgctggcggccgatccggtcgaagagatcaaagtcggtttcgatattttgaaatcgctgcgtatccgttcgcgcgggatcaacttcatcgcctgcccgacctgttcgcgtcaggaatttgatgttatcggtacggttaacgcgctggagcaacgcctggaagatatcatcactccgatggacgtttcgattatcggctgcgtggtgaatggccctggtgaggcgctggtttctacactcggcgtcaccggcggcaacaagaaaagcggcctctatgaagatggcgtgcgcaaagaccgtctggacaacaacgatatgatcgatcagctggaagcgcgcattcgtgcgaaagccagtcagctggacgaagcgcgtcgaattgacgttcagcaggttgaaaaataataacgtgatgggaagcgcctcgcttcccgtgtatgattgaacccgcatggctcccgaaacattgagggaagcgttgagggttcatttttatattcagaaagagaataaacgtggcaaaaaacattcaagccattcgcggcatgaacgattacctgcctggcgaaacggccatctggcagcgcattgaaggcacactgaaaaacgtgctcggcagctacggttacagtgaaatccgcttgccgattgtagagcagaccccgctattcaaacgtgcgattggtgaagtcaccgacgtggttgaaaaagagatgtacacctttgaggatcgcaatggcgacagcctgactctgcgccctgaagggacggcgggctgtgtacgcgccggcatcgagcatggtcttctgtacaatcaggaacagcgtctgtggtatatcgggcctatgttccgtcacgagcgtccgcagaaagggcgttatcgtcagttccatcagttgggctgcgaagttttcggtctgcaaggtccggatatcgacgccgaactgattatgctcactgcccgctggtggcgcgcgctgggtatttccgagcacgtaactcttgagctgaactctatcggttcgctggaagctcgtgcgaattaccgcgatgcgctggtggcattccttgagcagcataaagaaaagctggacgaagactgcaaacgccgcatgtacactaacccgttgcgcgtactggattcaaaaaatccggaagtgcaggcgcttctcaacgacgctccggcattaggcgattatctggacgaggaatctcgtgagcactttgccggtctgtgcaaactgcttgagagcgcggggatcgcttacaccgtaaaccagcgtctggtgcgcggtctggattactataaccgtaccgttttcgagtgggtgactaacagcctcggttcccagggcaccgtgtgtgcaggtggtcgttatgacggtctggtggaacaactgggtggtcgtgcaacaccggcagtcggttttgcgatgggcctcgaacgtcttgtattgttagttcaggccgttaatccggaatttaaagccgatcctgttgtcgatctatacctggtggcttcaggtgctgacacacaatctgcggctatggcattagcagagcgtctgcgtgatgaattaccgggcgtgaaactgatgaccaaccacggcggcggcaactttaagaaacagtttgcccgtgctgataaatggggtgcccgcgttgctgtggtgctgggtgagtctgaagtggctaacggcacagcagtagtgaaggatttgcgctctggtgagcaaactgcagttgcgcaggatagcgtagccgcgcatttgcgcacgttactgggttaaggaaggagaaggacagcgtggaaatttacgagaacgaaaacgaccaggttgaagcggttaaacgcttttttgctgaaaatggcaaagcactggctgttggggtgattttgggcgttggcgcactgattggctggcgctactggaacagccatcaggttgattctgcacgctccgcttctcttgcctatcaaaatgcggttaccgcagtgagcgaaggcaaaccggatagcatcccagcggcggaaaaatttgctgctgaaaataaaaatacttatggtgcgctggcttctttggaacttgcgcagcaatttgttgacaaaaatgaactagagaaagctgccgcccagttacaacaggggctggcagacacgagcgatgaaaatctcaaagccgtgataaatctgcgtcttgctcgcgttcaggtacagctcaagcaggctgatgccgcgttaaaaacccttgataccatcaaaggtgaagggtgggctgccattgttgccgacctgcgtggtgaagcattgctgagcaaaggtgataagcaaggtgcgcgtagtgcatgggaagcaggcgtgaaaagcgatgttaccccggcactgagcgaaatgatgcagatgaaaattaataatttgtccatctgagagggacccgatgcaattgcgtaaattactgctgccaggactgctttccgttacccttttaagcggctgttcgctgtttaacagcgaagaagatgtggtaaagatgtccccattgccaaccgttgaaaaccagtttacgccgactactgtgtggagcacttccgttggtagcggcattggcaacttctattccaatcttcatccggcactggcggacaacgttgtctatgcagcggaccgcgctggtttagtaaaagcgctgaatgcggatgacggcaaagaaatctggtctgtcaacctggccgagaaagatggctggttctctaaagatcctgcattactttctggcggcgtgaccgtgtctggtgggcatgtctacattggcaccgaaaaggcgcaggtttacgcgctgaataccagcgatggtactgtggcatggcaaactaaagtcgcgggtgaagcactttcgcgcccggtggtcagcgacggtctggtgttaatccacaccagtaacggtcagttacaagcgctgaacgaagctgacggcgctgtcaaatggacagttaacctcgatatgccttcgctctctttgcgtggcgagtctgcgccggcaacggcttttggtgcggccgtcgtgggtggcgataatggtcgcgtcagcgcagtgctgatggaacagggccagatgatttggcagcagcgtatttcccaggcgaccggttctaccgaaattgaccgtctgagcgatgttgacacgactcccgtcgttgttaacggcgttgttttcgcgctggcctataatggtaacctgacggcgcttgatctgcgcagcggtcagattatgtggaaacgcgaactgggttcggtgaatgatttcatcgtcgacggcaatcgcatctatctggtcgatcaaaatgaccgggtgatggcgttgaccattgatggcggcgttacgctgtggacacaaagcgatctgctgcatcgcctgctgacttctccggtgctgtataatggcaacctggtggtaggcgacagtgaaggttatctgcactggattaacgtcgaagatggtcgtttcgttgcccagcaaaaagttgatagttccggtttccagactgaaccggttgctgctgacggcaaactgctgatccaggcaaaagacggaaccgtgtactctattacacgttaatcgtctctgtcgttcactttgaaaacggctcctggacaggggccgttttcctgtttttaacaacgacacgaatatagcgtgcgttgtctgatgatttataaaaatgaggctttaaacatggtacctgtggtcgcgcttgtcgggcgccctaacgtaggaaaatccacgttatttaaccgtctaactcgcacccgagatgcgctggttgcggatttcccgggtctgactcgtgaccgtaagtacggtcgtgcagaaattgaaggccgcgagtttatttgtattgatactggcgggattgatggcaccgaagacggtgtagagacacgtatggcggaacaatcgctgctggcgattgaagaagcggacgtcgtactgtttatggtggatgcgcgcgcgggcctgatgcctgcggatgaagcgattgccaaacatctgcgctcccgtgaaaaaccgaccttcctggtggcaaacaaaactgacggtctggatcccgatcaggcagtggttgatttctacgcgcttggtttaggtgaaatctacccgatcgccgcgtctcacggtcgtggcgtattaagtctgctggagcacgtgctgctgccgtggatggaagatctcgcaccgcaagaagaagtcgacgaagacgccgaatactgggcgcaatttgaagcggaagagaacggcgaagaagaagaggaagacgacttcgacccgcaaagtttgccgatcaaactggcgattgtgggtcgtccgaacgtaggtaagtctacactcactaaccgtattcttggtgaagagcgcgttgttgtttacgacatgcctggcacgacgcgtgacagtatctacattccaatggaacgcgacggacgtgagtatgtgctcattgacaccgctggcgtacgtaaacgcggcaaaatcaccgatgcggtagagaaattctcggtaatcaaaacgttgcaggccattgaagatgccaacgtggtgatgttggtgattgatgcgcgtgaaggtatttccgatcaggatctctccttgctgggctttattctcaatagtgggcgctcacttgtgattgtagtgaacaagtgggacggcctgagccaggaagtgaaagagcaggtgaaagagacgctggacttccgtctgggctttatcgattttgctcgtgtgcactttatctctgccttgcacggcagtggtgttggtaacttgtttgaatcagtacgtgaagcgtatgacagctccacccgtcgtgtggggacctctatgctgacgcgcatcatgacgatggctgttgaagatcaccaaccaccgctggtacgcggtcgtcgtgtgaagctgaaatacgcccacgccgggggttataacccgccgattgtggtgattcacggcaatcaggtgaaagacctgcctgattcctacaagcgttacctgatgaactacttccgcaaatcgctggacgtaatgggatcgccgattcgtattcagttcaaagaaggggaaaacccgtatgcgaacaagcgtaacaccctgacgccaacccagatgcgtaaacgtaagcgtctgatgaagcatatcaagaaaagtaagtaatcacttatctggtttccctttccacacggagagggaagccgaataacacgcgaggagtatttatggcactcaactgtccaacctgcaaaacccctctcgaacgcaatggcgagactgctcactgtgcaacttgcgacaaagactttaccgtccaggcactttgccctgagtgtcatcaggcgttacaagtgttaaaagcttgtggtgctgtggattatttctgccaacatgggcacggtttaatatctaaaaaacgcgttgaatttattattgcttaatatcatgtgaatgtattgttttatcatttatatttaatatatgaatgataaacaatctgttattagtggaataactaatgtatttgagtgaaatcactaatttaaataattaagaatatatttactctttatgacatgcctttctgaataatcagggatacaatattaaagcttatttttgactgtatcattgtcacagggaaagtgcatgctgcgatggaaacgctgtattattctaacatttatctctggtgctgctttcgcggcgccagagataaatgttaagcaaaacgaatcgttacctgatttaggtagccaggcagcacaacaggatgaacaaaccaacaagggtaaatcgctgaaagagcgcggagccgattacgtcatcaactccgccacgcaagggtttgaaaacttgacccctgaggcgctggaatctcaggccagaagctatctgcaaagtcaaatcacctcaaccgcacaatcttatattgaagacacactctctccctacggtaaggtccgttcgaacctctccattggtcagggtggcgatctggatggcagttccatcgattattttgttccctggtacgataatcaaaccactgtttatttcagccaattttctgcgcaacgaaaagaagatcgtacgatcgggaatattggccttggggtaaggtataattttgataaatatctattgggtggaaatatattttatgattatgactttacccgtggacatcgccgtttaggtttaggcgccgaagcctggacggattatttaaaattctcaggcaactattatcacccactttctgactggaaagactctgaagatttcgacttttatgaagaacgccctgcgcgcggctgggatattcgcgctgaagcctggctacccgcttacccgcagcttggcggaaaaattgtcttcgaacaatattatgggaatgaagtcgcgctttttggtaccgatagtctggagaaagatcccttcgctgtcacgctgggtgtgaaataccagcccgttccgctcattgttgtcggtacagatttcaaagctggcactggcgataataccgatctttctgttaacgcaacgctgaactaccagtttggcgtcccgctcaaagaccagcttgatcctgacaaagtgagcgcggctcactcgctcatgggtagccgtcatgactttgttgaacgtaacaactttattgttctggaatacaaagagaaagatcccctctatgtcactttgtggctgaaagccgacgtcacgaatgaacatcccgagtgcgtgattaaagatacgcccgaagaagccgtcggtctggaaaaatgtaagtggaccattaacgcactcattaatcatcattacaaaatcgttgctgcctcctggcaggcgaaaaacaatgctgcccgcacgctggtgatgccggttatcaaagagaatactctgacagagggtaacaataaccactggaacctggtgctgcctgcctggcagtacagttccgatcaagccgaacaagaaaaactcaacacctggcgggtacgcctggcgctggaagatgaaaaaggcaatcggcagagctccggtgtggtggaaatcaccgttcaacaggaccgtaaaattgagctcatcgttaacaacatcgccaatgtcccggataagagcaatcacagccacgaagccagcgcacaggccgatggtgtagatggtgtagtgatggatctcgatgtaaccgacagctttggcgataacaccgaccgcaatggcgatgcgctgccggaagataacctcacgccgcagctttacgacgcgcaggacaaacgagtgacgttaaccaacaagccttgctcgaccgacaacccctgcgtttttatcgctaaacaagataaagaaaagggcactgtcaccctctccagtaccttacccggcacctatcgctggaaagcaaaagccgcgccctacgatgacagtaactatgtggatgtcactttcctcggggcagaaattggtgggctaaatgcttttatctatcgagtgggggcggctaaacccagcaacctgataggtaaagataaagaaccgttgccgcttaacaacatttatcgatttgttttatggcgcgacaacaataaagacggtgtcttccagcaggtcgaaaaactgactgacgaagagatggcgcagtacgactacaagtgggaatttaccggcaagagcatcaatggtgaagtgggtgcacaggcgaacacttccaatgaggacattgtgattccggccactaaccgtgaagcggcgcaaacctatggcgcacaagcgggagatggcttgcaggggtacggtttacgcgtgctgtataccaaaaaataagattggcgtaaggccagtcggccagtcgctgaaggttcattaaggagagcatcaatgaagcaggataaaagacgcggtctgacccggatcgcattagcgctggcactggcaggttattgtgtggcacctgtggcgctggctgaagacagtgcctgggtcgacagcggcgaaaccaatattttccaggggaccattccgtggctctattcggaagggggaagtgctacgacagatgccgaccgtgtaacgttgacttctgatctaaaaggcgctcgcccgcaaggcagtgaaacggacaagcgtctttactcgggtgataaattaaccgtaagttgggaaattggtgataccgaaggcgacgtggatcttggaggattgggcgataacgcgaaaactatcgatactatccgctggatgagctacaaggatgcgcaggggggggatccaaaagagctggcaacgaaggtgaccagttacactcttaccgatgccgaccgtggtcgctatatcggtattgaaattacgccaaccacgcagaccggtacgccaaacgtcgggactgcgctgcatctttatgacgtttctactgccagcggcggcggaagcgacagcgataacgttgcaccggggccggtggttaaccagaacctgaaagtcgccatctttgttgatggtaccagtatcaaccttatcaacggtagcacgccaatcgaacttggcaaaacctacgtggccaaactgtactcggatgagaacaaaaatggcaagtttgatgcgggtaccgatgctgacgtcaccgccaattatgacttccgttgggtactttctggcagcagccaacagcttggcacttcgggtggcatcgttaactcaagcttcgataataacaatttggtcatccctgcgaccaacgacgaagccagaaccaaccttaacggccctgcgcgcgatggaaaagaggcactttccatcccgaccaacggcgacggggtacagggttacaaacttcacattatttacaaacacaaataacgcgtactcagcagcattcccgcaagggaatgctgtttccgcatattttgcttaatcccggattaagcaaaatatgttgatgcgacaagcgtccgtttaacaaccggtggagtttctgtcatgtccctgaccctgaataaaatccttgtgttatgcgcattgctgataagcgcaatgctgcctgggtggtcatgggcagaatctgcatggcaagactcttcagatacggtcggcgaatttaacggtaccgtgcctactgccgacagcgccagcatacccgtctaccagggcagtgtctttctcgatcctgcaaagacgcatgatgtagcgtttaccgctaaaccgagtgaattcagcgcggatgttagcgtctctaaattgctcgtcaccaatccgcaagacagagaaggcgatatcattgccaccccacgttgggaaaaccaaacgccaccggcaatatctttagtttgggcggatgccgcgacgccgggcaccttactggacccacagccagtcgcagatcgctcgttttgcgctcagggccttgccgggcgttcgctggtcgcctgggcgcagcctgatccccagcagaccatgccgctgttatatttactcacctcgacgggctatccctatgaaagtgttctgacgctcgccgatcagaaagtgacgctgaagattgcgcccgcgcagggtgaccttatttccgtcagcgctgcgggctatgacgaatcctcaggtgcggcgaaaatgacggttggcggcagtatcacgttaacggtcaccaccaaagattgcgtcggtaatgttgtggggaatattccttttgttatcaaacgcaaagatgctgaaaaccgccagggtgtggtgaacaatactgcgcctgtaaaactgggcacgaccgaattaaccaccaccgcgacggaatatcgtggtactaccgatgcgaatggtgttgccacggttacggtcacccaggccaacggccctggtgtaaaaacgccgttggtcgcgagcctcgcgggtattgctcaggccagtgaaacggcagtgatctttaccgtcctcaccagcccggatgtcccgcaggctacaatgtggggtcatatgcccgatacgctgaaggcccgtgattacacttttagtcgaccaaaactggcggcggaagtcgataatgaagacggtacggttaacgatcacaatgaaacctggtccacctttacctggagcggcgcggataaacattgcgacattttgcccggaatgcgtcagttcggtgcgctggcgacggtggtgccaacgtcagtgcaggatgtggctggttggccgatgcagggtaatttctactggtcatcactggcggggatgagcggccagcaccatgcggcggatgtttcgaaccgcagcgaagcgcaaaaaccggacgatacgacgtttattgtgagctgtgtcgataaagaagcgcccgatgttgaaccgaagctggtactgacgccgggcagctatgattcgacgataaaagcgatgaaagtaaaggtgggggaagaggcttctttacgtctgacgattaccgatagcaagaacaacgatcagccgctggcttactactacttttcgctgcatctggatgacggcattaaccgtaagaatcaaactgacgccgcgtgggagacgcatccggtacaaattgatggcggcagtaacgttcgcaaagttgacgcccatacctatgaagggatcactgatgctaacggagaggccactctgacgctgacccagccaggcggcgtgggggtgaaaactcacatcaccgcgagaatgcgcagtgattttactgcctcggatgagaaagacgttatttttacggtgatcaccagccccgataccgacaaagcgcggatgtggggccatatgttgggcattattgaagcgaacaatatctttaaacgcccacggctggcggatgaaaccgacaacgaactgggatcggtgcgggaaaataacgaagactgggcgctgtttgatcagaatagcagtatgcaggctgagtgtggtttaggtcatattccgagccaaagttcattgcacagtttgtttgccgctcatccagccaatgccatcggcaccgaatatggctggccaacgttgcaaaaagcgtatcttagtgcggtggaagagacgtcgcacgcgtcggtaaacctggccacgggcaacatcgacacctattccggctttaagcaaaactatctctcttgttcgggcaatgagatggtcgccaagattgccgcgaccaccgatcgtgatgtttccgcaggcagcagagcgcaggccaaagtgggtgacacgatcaccatgacggtacgcacctttaatgccttgaataatgcacccgtgccgtataccgcgttcaccatcactaaagatatggggaaaaatcgtcaggggcagactacaggttttgatgatccaacccgcggcgcaatcgagatgaatggcacactctacggaacatcgcaaccgtctttagtctatgccggtactacggatgcgcagggttttgcgactgtggaaattaagcaatcgcaaggtgtgggcttatcgacgccgctaaatattgtgcctgtgaactcctatattcccaatactgttaattacaatgtgattttcactacgctcaccagtccggatgcggttggcgcgcagatgtgggggcatatggatgagacgattaccgtcgatgctttaacctttgcccgaccccgactggctgcggaagtgttcagtccggacggcacattaacggaaaataacgaagtctggtcgcgagtcagccaggccaacgcctccagcaccagtaaaggtggctgtggcgccaatatgctcccacgccgttctcagcttagtgcgctctatgatgccaataacggtaacggtgtacagacagtacacggctggccaacgcagcgtcagccctactggagcagttcgcccgcagatcaggtaccgcattattacaccatagccctcaacgatggggcgcggaccgttggcggtagcacggcggtttatgtcagttgcctgacgacggctaacaatcctgccagcagcattacgctggaagtggtagatccggcgcagtggaacgcggctgcaaatgcggcgaagctgaaaaaaggcgaaacgctacaggtaaaggtgacggtaaaagatgcgcagggcaatccattgggtgatataccctttaccctgaaacgtggcgatggttatacccgctcagaggaaaaacacgttgctggtagcggtgatgcgctggttgcgccggttgtggtcaatggtggcctggcggacgaaacttcgcttaataataccgctgcagcatacagcgccataaccggcagcgacggaactaaaattctcactattacccgcccggatacccatggcacgaaaacgtcgctgaccgctacgctctattcagatacaacgaaaaaagcgaccctcgataccatttttaccgttgtaaccagtccggacagcgataaggcgaaaatgtgggggcatatgcctgaaacagtgacggctgcagatggaacggtctttaaacgcccattattgttgaaagagttatccagtacgtcgggtcgaacagcgattgcagaagagaatgaagactgggcgcaatttacccaaacccaggctataagcacatcctctaatggttgtggtagtgaatatgttccctcccaggccgggctggagtcattgtatgaagccaaccgcggcaatgcgatgaaaacggttcagggctggcccgtcgcctcaagttacctttccagcacgacaggtagtagtagcctggaacagcgtgacttcaaggccgtcaatctcagttcaggcaccagttcgataattccatctgccacaaaagaactgcttacctgccagacgacgccgattgttaaggcaagccaaattgttcttgaagctgcagaccccacaaaatttgacagtacgaataatgttgtcaaagcgaaaaaaggcgaagaagccgtattacgagtgaccactaaagatgcgcagggtaaccctgtgggaaataccgcatttaccctcaaacgaaacaccagcgtgaacagggccaatgtgtcaactacgacgtcgattgcttcgctggcggtaacggatgcctggggaaatactcaagatgattttctttcaacgaccctggttatttatggcgtgacgggggctgatggcatcaccactttcacattgaagcaagaccagactaccgggctaaaaacagaactcacggcagcgttggattcctccagcagcactaaatcgacgcttcccgttgtctttacggtgcttaccagcccggattcgccaaaagccaaattctgggggcatatggctgaaacggcgacaggcgatgacggtcttatttatcgaaggcctttactgagggacgagaatagtgctaccaccagtatcggtaccctggtggaagagggggaggcctggtctacgttcccgtcgggccaggctaacgatacctcgataaatggttgtggcgcggagtatgttccaactgacaatgaacttagggccatttatgcgcaccaggggagtagcgcattacatgatgctattggctggccagtgtcgaggttctatatctcgaataccgttgcagatacgttcactcaaacctttacgtatgatgtcgtttcgctgaagacaggagatgaaacgcagatgccctcatctggtggtgcattactgagctgccggaccacgcctgtcgccgttgccagtcagatcattgttgaggcgaatgatacggcgcaatttgtcaaagttgacgacaccttgagtgcgttgaaagtgaaaaaaggcgaagacgcggtgattcgcgtggtgactaaaaatgcgcagggaaatagcgtgcccaatgtcccctttattctcagacgtgaaggctcgaagaaccgtcaaaatgccgagatgataaataagtcgattacggtaattaacgcggcaggcgcttctgcgaggatgaatagttcttcaagcctgctttatggggtgactggcgcggacgggactacctcctttacggtaaaacaagatgattctatgggcctggtaaccaatatgtacgcccagttgtatcagctgacgatagaatccaacaaattaccggtcatgtttaccgtcataaccagcccggatacgccactggcaagttactgggggcatatgtctgaaacgtttactacccggtcgggaattgcctttaagcggccattgcttactgccgagcatccagcgggacagtcaaccatggctaataatgaatcatggctttctttgaatacggcagcaaaaaatgatgtcagcaaatcagactgcggcgaaccttatcaaccgttattaagcgaatttcaagagttatacagtgaacatcctaatggtgcgatagggaccgatttaggccttccgctgactaacacctggtgggcttacgataaaattgcctacgcgaacgtctggtacgatcagtctattaatttatcgaatggatcaagctccagggcattatcaaacaccgtggcatttgtgtcctgtctggtaaaccctcatgcagtggcagcttctataaagatgacctccacggcactggatgcggagaaaacggccagcaacgatggtcgccctagtgcaacggcggcgaaaggtacggcgatccggatgacggtgattgtgcgggatagcggaggaaatctgttgccaggcgcaaactttaatctcatacgcgggactgcgttggatcgtgcaaaaaacaggctagattctacgtatgatgatcttactatcgtgccggtcacccctgccggagtaaacatgtcactctataataatggggcacaggcacttctgacgacaggaagtgatggtaaagcgacttttgatgtgacgcaaaacgagacttatgggctggcaactccgctcactgcaacattgatgcgcgacaccacaaaaagtgccacgatggatgttattttcactgtgataaccagtccgaactcaccgaaagcaaaatactggggtcatatgcccgacacgtttaccagtagggcgggggtgacctttaaacgaccgctactggcagcagaagcgaccttggggtcctcggtaagtaataataatgagtcgtggtcataccttttttataccaataaagttacgccggattgcccggttgagtatcagccgcgtctcaatgagttacaggggctatataatgatcatccaggcgggacaatactgacagatttggggttgcctataactgccggaagtggaaattggtggacttatgaaatgagcaccactgacgcgttgacgtggtattacggcgtcattaatttgaaaacgggacaatcgacgacgactattaatggatacgctttaatgctctgtctgacgcagccacattcggcaccagcaagccttacgctgtcatcgactgcctatgatgagggccgaactgccagcaatggtggtacccccacgtcatctgtgaaaaaaggtgagatgcttcccatcgtggtgacgatcaaagatgccaatggtaatcctgttggcggcgaaggtgttacgctcaagcgcgtgcaggcgaaaagccgttcagggatctctgtatcctccaataccgtagatgatctcattttagatgaagtcaccccgacatcggcgcgtatctccttcaaccagaatacgtcggcatggagcggcttcaccggcagtgatggcacgataacgttcaacgttacccaaaataacaccgttggtctggtaacgccgtttacagcttcattggcgcgaaatccgcaggttacggctaatcaggacctgatattcacggtagtgaccagcccggattctgcgaaggctaactactgggggcatatgccagcaaccttgacggcagtgaatggtgcggtatttgaacgcccgaaattgtggagtgaactgacatcgacttctggcgtcggcaagatcaataacaataatgaagactggccgtactttaccccaacacagaaatcagatgcgagtgtgagcccttgtgaagtagcaaggcagccactattcaatgatttaagttcgttgtctgcgcgttatccgaataacacgtttgtcactgaaactggctggcctgcgtattacacctggtgggcagaggataaatccgccgatggtaaagaccagtcggttgatttgagaaatggcacgctgtatacgggttcaacaaaatcatttcagccttgcctggctaacgcgcgttcaaccgtttccagcgtcacactgacctcaacagcgtttgatgctgacagccaggcggcgaaagtgaaaaaaggcgaagccatgtccgttaccgtgacggtgaaagacagcgccgggaatacggtgccgaatgttgaatttactttgaaacgtggtgaggcatcgccgcgtaacgctggggcaacgttgtatggcaatgtagtggcgatggacgatctcatcgttcagccgttatctggttcggctattacgctgagtgaaagcggtaataccattagtggcatgacaggcgcggatgggacggcaagtttttcgctccgccaggataatacccctggttataaaatgccactgacggttactctggctaattacgcttccgcgacagacacgctggacgctatttttacggtgccaaccagcccaaatgtttcatcggcgcacttttggggacatatggcagacacggtagtggtgaatagtaaatcgctacatcgaccgttgttaacgacggaattgccgtccggggctaatcccgtatcctcaccgattattaactacgaaaactgggcttctgcacatatcattgatgccagtaaatgggatatcgcaaggcagtgtggcagcatagaaaatgcaccgacatacaatgaattagagttgttgcatactgtttttaattcactgggatggccgtcttcacccagttttccttatttgtcctctcaacagtgtgggatggacgaaggtaccggagcacaggattgtagtatcacgctaataaataaaccgggtctggtgacctgcttccagtaaccagcatggcggatctggcgtagcctgggagttattgccggatgcgatgctggcgcctcttatccggtctacggattagacgtttttttacgtgatttgcgggtttttgttacggcgctgacttcactaatcaccacaccatctcccagtcgtgtggtcagtgtctcacccactttcacttgcttaacctgttttaacagcgcgccatcagcggcgctggtgacgctataaccgcgcgccagcgttgacagtgggcttacggcttcgaggtgtgttactgcattaccgaaacgttcacgcgtggcgctaagctgtgcgcgcagggtttctgctaaacgatattccagttgctgaatgcgcgtttgcgcgcgatgaatacgcgactgcggattttgctggacgagttgccgtgttaatcgctgctgttgctgacccgcgcgtttaagctgattctccagcgcaaagctcatccgcttttgcagacgttcgagcatagtttgctgacgtgccagccggagctgcggatgctgttgctgtaagcgatgatggatctgcgtaaaacgacgcgtgcggttggcgagataataatccattgccatttcgaggcgctgctgcgcagactgcacctgacgcagtaactcctgttgattgcggctcactacttcagcggcggcagacggcgttggcgcacgcaaatcagcaacaaaatcggcaatcgtcacatcggtttcatgcccgacggcacttactaccggaatgaggctggcaaaaatcgcccgcgctacgcgttcgtcgttaaaactccacaaatcttccagcgaaccgccgccgcgcccgacgattaacacgtcgcactcgtttcgctgattcgccagctcaatggcgcgaacaatttgccccggcgcgtcatcgccctgaacggcggtggggtagatgatcaccggcagagaaggatcgcgacgttttaacacatgcaaaatatcatgtagcgcagcaccggtttttgaggtgatcacaccgacgcaatgcgcaggggagggaagtgtttttttgtattgctgatcgaacagaccttcagcctgcaatttcgctttaagctgttcgtatttttgttgcagcaacccttcaccggcaggctgcatactttcgacgataatctggtagtcaccgcgcggctcgtagagcgtaatattggcgcgaactaaaacctgttgcccgtgctgtgggcggaaggtgacccggcggttgctgtttcggaacatcgcacagcgcacctgcgcggtatcgtctttaagcgtaaagtaccagtgaccggaggctggttgtgtaaaattagagatttcgccgctgatccacacctgccccatctcatgctcaagcagcagacgaactgtttgattcaggcggctaacggtaaaaattgcaggggattgagaaggtaacatgtgagcgagatcaaattctaaatcagcaggttattcagtcgatagtaacccgccctccggggatagcaagcattttttgcaaaaaggggtagatgcaatcggttacgctctgtataatgccgcggcaatatttattaaccactctggtcgagatattgcccatgctacgtatcgctaaagaagctctgacgtttgacgacgttctcctcgttcctgctcattctaccgttctgccgaatactgctgacctcagcacccagctgacgaaaactattcgtctgaatatccctatgctttccgcagcaatggataccgtaacggaagcgcgcctggctattgctctggctcaggaaggcggtatcggctttatccacaaaaacatgtccattgaacgccaggcagaagaagttcgccgtgtgaaaaaacacgaatctggcgtggtaaccgatccgcagaccgtactgccaaccacgacgctgcgtgaagtgaaagaactgaccgagcgtaacggctttgctggctacccggttgttaccgaagaaaacgaactggtcggcattatcaccggtcgtgacgtgcgttttgtgaccgacttgagccagccggttagcgtttacatgacgccgaaagagcgtctggtaaccgtgcgtgaaggcgaagcccgtgaagtggtgctggcaaaaatgcacgaaaaacgcgttgaaaaagcgctggtggttgatgatgaattccacctgatcggcatgatcactgtgaaggacttccagaaagcggaacgtaaaccgaacgcgtgtaaagacgaacaaggccgtctgcgtgtaggtgcagcggttggcgcgggcgctggtaacgaagagcgtgttgatgcgctggttgccgcaggcgttgacgttctgctgatcgactcctctcacggtcactctgaaggtgttctgcagcgtatccgtgaaactcgcgctaaatatcctgacctgcaaatcatcggcggcaacgtggcaactgctgcaggtgcccgcgcgctggcagaagccggttgcagtgccgttaaagtgggtatcggccctggttctatctgtacgacgcgtatcgtgactggtgtcggtgttccgcagatcaccgccgttgctgatgcagtagaagccctggaaggtaccggcattccggttatcgctgacggcggtatccgtttctcaggcgatatcgctaaagctatcgctgctggcgcaagcgcggtgatggtaggttccatgctggcaggtactgaagaatctccgggtgaaatcgaactctaccagggccgttcttacaaatcttaccgtggtatgggttccctgggcgcgatgtccaaaggttcttctgaccgttacttccagagcgacaacgctgccgacaaactggtgccggaaggtatcgaaggccgcgtagcctataaaggtcgcctgaaagagatcattcaccagcagatgggcggcctgcgctcctgtatgggcctgaccggctgtggtactatcgacgaactgcgtactaaagcggagtttgtacgtatcagcggtgcgggtattcaggaaagccacgttcacgacgtgaccattactaaagagtccccgaactaccgtctgggctcctgattctcttcgcccgacttcatgtcgggcgatttatattatctgtttcacttgcctcggaataagcgtcaatgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaatccaagcggcattattctttccggcggcccggaaagtactactgaagaaaacagcccgcgtgcgccgcagtatgtctttgaagcaggcgtaccggtattcggcgtttgctatggtatgcagaccatggcgatgcagttgggcggtcacgttgaggcttctaatgaacgtgaatttggctacgcgcaggttgaagtcgtaaacgacagcgcactggttcgcggtatcgaagatgcgctgaccgcagatggtaaaccgctgctggacgtctggatgagccacggcgataaagttaccgctatcccgtccgacttcgtcaccgtagccagcaccgaaagctgcccgtttgccatcatggccaacgaagaaaaacgcttctatggcgtacagttccacccggaagtgactcacacccgccagggtatgcgcatgctggagcgttttgtgcgtgatatctgccagtgtgaagccctgtggacgccagcgaaaattatcgacgacgctgtagcccgcatccgcgagcaagtgggcgacgataaagtcatcctcggcctctctggtggcgtggattcctccgttaccgcaatgctgttgcaccgcgctatcggtaaaaacctgacttgcgtattcgtcgacaacggcctgctgcgtctcaacgaagcagagcaggttctggatatgtttggcgatcactttggtctgaatattgttcacgtaccggcagaagatcgcttcttgtcagcgctggctggcgaaaacgatccggaagcaaaacgtaaaatcatcggtcgcgttttcgttgaagtattcgatgaagaagcgctgaaactggaagacgtgaagtggctggcgcagggcaccatctaccctgacgttatcgaatctgctgcttctgcaaccggtaaagcacacgtcatcaaatctcaccacaacgtgggtgggctgccgaaagagatgaagatgggcctggttgaaccgctgaaagagctgttcaaagacgaagtgcgtaagattggtctggagctgggcctaccgtatgacatgttgtaccgtcacccgttcccgggaccaggccttggagttcgtgttctgggggaagtgaagaaagagtattgtgacctgctgcgccgtgctgacgccatcttcattgaagaactgcgtaaagcggacctgtacgacaaagtcagccaggcgttcaccgtcttcctgccagtacgttccgttggcgtaatgggcgatggtcgtaagtatgactgggttgtctctctgcgtgctgtcgaaaccatcgactttatgaccgcacactgggcacatctgccgtacgacttcctcggccgcgtttccaaccgtattatcaatgaagtgaacggtatttcccgcgtggtgtatgacatcagcggcaagccgccagcgactattgagtgggaatgatttgaaccctgcactatgaatgaacaaaaccctctgttactacagagggttttttatactcacgaatcataggcttgaagttactgacatcgcttagttaaaccagctgtccgatttgttctcttctgctttacccacgcttttcatcagatcgcgaccgccttcagtcatatttctgtttgcgtcagcttcagattgcaccacatcggtttgcgcagctttgtgcttcagttcctgatcgataaattcgttttcgcgcttgacgcgggcttcttctttcgccagcgccagtttttgtttctgaatctctaagctgcgtagctcatcttcataactttgatcgcgttttttgtccgcagtggcttcggcgtccagtttatcctgacgagctttcttattcgccgctgccgttgccgctcttttattagccgcggcctgggcgtttgcgcgacgttgcttctcttgctggatttccctgttgcgctccgcgacccattcgtcatgctgcctttgctcttcatttttaccttgctgttccgcttctgcgacagccgagagttgatcctgcaatgatgaggcgatagccggatagcttaaggaggctaagatggcgcaaagaaaaactttcttcatgactcctcctgattattagctcttttcaggacatttggtatttggctgaatacgcgtttcgttatacgtcgtggtaataacaacggctaaacctgtcgtaaactggcactctttacccacctgggtggaggtatacactttggtgccttccttatatgttaaagaaacaccttccactaaggttttatcattcaccatcgaacccgctgccgcgcctacagctccgccgccaactgcacctgccgtcgttccggaattgctgccagacccgacgttgtggccgataacaccgccagcgacagcgccaataagcgcgccgaaggcttgtgcgttccgtttattttgggcgttgtctacggcaacttttgcgggaagaatggaaataatattaacggttttagtttcttgtttggtattcagttgatcggtttgataaacatcggcagcatgatcatcagcatttgactggcatcctgccagagtgaatgacgctaacattgccacaggcagaagacattttttaaatttcatcactattccttgttatacacattacgaaaaatgagacatttaagatcatcaaaagaggaaagtaaatgtattgcgtataaaggaatagattaaatttattaaaattcatgcgggaaataatttataaaaatacatcatcacaacatatgtattaatgatgtatttatttcgcagccgaacaggatgaacttcagtcagaacaaagacgtaaaatttaagatgaaagaatatctgccgctttgataatctcaaagagcaaaagcatccgacagcgaggtgccgttatgttctgtgagagtggagaaggtaaccgctaacgttgtaccggtgattcgacggagagtgtggattgctgagcttcttttttgctctgatggtgctgccaggcaccgacggacgagtagataaaacggccaaagaagaagataaagctgatgagcagtacgatacgggtcatgcgactgttaaatcggtgtcgttttcgcatactggttgcctgactcacaaaaggttccttgaagtatgtcccacgccgtggacggtacttacattaaggcacaacaggacaaaatggtcaattcttcgttatgtaaaaaagcgtcagtggatacatattttaatgttatggaagttaatttaattatttacaatgatgatgtaataatgatgagttaacatgataaacgtaataattcattaatcagggttattttgtttgatatatatcaattggaactttcatatgacacttagaatcattgctctctatagtgatgaataatcatcattcgaagtcaggtgggatgcctgtctgaatacacctccttcaggatgtgggggattctgctgagcatctatgaaactgaatgcaacttatataaaaatacgtgataaatggtgggggcttccgctgttcctgccttctttaatcttgcccattttcgcccacattaatactttcgcgcatatttcttccggtgaagtttttctcttttatctgccactggcactgatgatcagcatgatgatgtttttcagctgggcggcattgccagggatcgccttagggatttttgtccgcaaatatgcagagctgggtttttacgaaacgctctcattaacggctaattttattatcattatcattctctgttggggcggttacagggtttttactccccggcgtaacaacgtttcacatggtgatagccgtttaatttcccagcgactattctggcagattgtgtttcctgcaacgctgtttctgatacttttccagtttgctgcgtttgttggattactggcgagcagagaaaatctggtcggcgtcatgccctttaacctcgggaccttaatcaattatcaggccttgctggtgggtaatctgattggtgtcccgctgtgctacttcatcattcgggtggtgcgaaatccgttttatttacgtagctattattcgcaattaaaacagcaggttgatgccaaagttaccaaaaaagagttcgcaatctggctactggcattaggtgctttattgttgctgttatgcatgccgttaaatgaaaaaagcacgatttttagcaccaattacaccttgtcattattgctgcccctgatgatgtggggagcgatgcgctatggttataagctgatttcattgctctgggcggtcgtgttgatgatcagcatccacagctatcaaaattacattcccatttatcctggctataccacgcagctgaccataacctcctccagttatctggtattctcttttattgtcaattatatggctgtactggcaacccgtcagcgagcggtagtcagacgcattcagcggcttgcgtatgtggacccggtggttcatctgccaaatgttcgcgccctgaatcgcgcgttacgtgatgccccctggtctgcgctttgttatttacgcatccctggcatggaaatgctggttaagaattatggcatcatgctgcggattcaatacaagcaaaaactttctcactggctgtcaccattgttggaaccgggtgaagatgtttatcagctttcgggtaacgatctcgcgctgcggctgaatacagaatcgcaccaggagcgcattaccgcactggatagccatctcaagcaatttcgtttcttttgggatggaatgccgatgcaaccgcagattggcgtcagttactgctatgtgcgctcgccagtgaatcatatctatctgctgctgggagagctaaatacggtggccgaactttccatcgtgaccaacgccccggaaaatatgcagcgtcgcggagcaatgtatttgcaacgcgaattgaaagataaagtcgcgatgatgaatcgactacagcaggcgctggaacacaaccattttttcctgatggcccagccgattaccggtatgcgtggtgatgtttaccatgaaattcttctgcgcatgaagggtgagaatgatgagctgatcagccccgatagcttcttaccggtcgcgcacgaatttggtttatcgtcgagtatcgacatgtgggtcattgagcatacgctgcaatttatggctgaaaacagagcgaagatgcccgctcaccgttttgctattaatctgtctccaacctcggtatgtcaggctcgttttcctgttgaagtcagtcagctgctggctaaatatcagattgaagcgtggcaacttatttttgaagtcaccgaaagtaatgctctgaccaatgttaagcaggcgcaaatcaccttgcagcatcttcaggaattaggctgccagattgcgattgatgatttcggcaccggctacgccagctatgcgcggcttaaaaatgtgaatgccgatctgcttaaaattgacggcagttttatccgcaatattgtgtcaaatagtctggattatcagatagtggcgtcgatttgccacctggcgcgaatgaagaaaatgcgggtagtggcagagtacgttgaaaacgaagagatccgcgaggcggtgctctctttggggattgattatatgcagggttatcttattggtaagccgcaaccgttaattgatacgctgaatgaaatcgaacccattcgcgaaagtgcctgaataatgcgggccgacatttctcgtcggcccgcaaagcattaagcggcgatttctggtgtactttcttcttcaattttcaaccgccagccagccacgccttcccagtattcttgctccttttccagatcaagcagtaccagcgcattctgactaaaccagtcatgcgggaaacgcagtgtccagtgactgtcatcagtaatcagcgtcaatgttggcggtgtggtggttgcctgacgttgattattgagtaatacgccaaggcgcaatagctgaatcagtggcaggaactgtttcttcttaaacaaggtaaagcgcggcagatcgtcgagtttaatcgctttacggtgatagcgcaccagtgtcgccatcatcagctgctgttcctgattaaaacccggcaagtcgctgttttgcagaatataagcggagtggcgatgcaaaccgctgtggttgatattcaacccgacctcatgcagcatggcggcccatcgcagtagcgcctccagttgtggatgcgccagcttcggttgctgttcccgccactgttcgtacatttgcatagtggtatccagcacccgtcgggcctgttcgctgtcgatgtgatactggttggcgaggctgctggcagtgcgactacgcacatcctgatgacggaaacgtccttccatttcatacagtacgccttcgcgtaacgccccgtcagaaaggcgcagttcacggatggctaaagcatcaaacacaccgcataaaatcgccagtccaggaacgaagactgttttccgctcttcggaaagacctggtaaactcagcgatgcgaaattacggtgccgtaaaacttcttttaccagtttttccagacgttccggggtaattatcccgtctttctcgcccatttccattaacacttcatgggcggcttttatggtaccggaagcgcccattgccacgttccagccctgaattcgaaattgccaggttaacgtttccagtttttgtgctgccgccatgcgagcgcgctgaaaattctctttattgatgaccccgccatgaaaataaagctgggcaaagctgacacaacccatccggcggctttcaacgagaatcggttcgaaattttcaccaatcaccagttctgtagaaccgccgccaatatcaataaccagtttgcgacctttttccggttgggtatgttccacgcccataaaaatcagacgggcttcttcattaccggaaataatttcgatcgggtagggaatgactttttccgcgcgtttcagaaagtcagtggcgttcagcgcctgacgcagcgtatgggtaccaactatacagacgctggcaggagaaaacccttgtagcctttcggcaaatagcgacagacagttcaaaccgcgcgtcattgcctcttcactcaacatattatctggccccaggccgtccgccagatgcacccgctgtttcaggcggccaataatctgcatggcaccatctaccacacgggctatgaccatgtgaaaactgtttgaaccaagatcgaccgcagcaaactcctgcggacgaggggatttatcgtgtattggcatagggttattcagattgttcgagtgatttgatgtagtcgtaaatcgccaactgcgcccgtactttgcggcgattgccgcggggaacgtagcgattactgagttctttatcgatataacgtgctttgaccgtatcgctgaacaatatgtcgatgatgtccagcacccgctgcttcaggcgcggatcgagcagcggcgttgccacttcaatacgataatcaatattgcgcgtcatccagtcggcggaagaaaggtagacctttttatcgccgccattttcaaaaatataaacccggtcatgttcaaggtaacggtcaacaatactgatggcacgaatgttgtcgctaatgccttccagattggggatcagagaacacattccgcgcaccagcagattaaccggtacgccggagctggaggccgcatacagacgatcaaccaggcctttatcgacaaggttatttagcttcagggtgataccactgggcagcccttgctgcgcgttggcgatctcgcggtccaccatttcatacaacagacggcgagagttttgcggcgacaccattaaataatcaaatgtcaccggacggtatgggttttcaataaagttgaacacccgccgtacttcgttagtgatgcgcgcatcggcggtcagcaacgaatagtcagtataaagacgcgcggttttttcgttaaagttcccggtcccgatgtgtgcgtaacgcaccacttcaccgttttctttacgtgaaatcaggaacagtttggcgtgaattttcagccccggcgcagagaagataacgtgcacgcctgcttcggtcaggcgcttcgcccagtgaatgttggcttcttcgtcgaaacgcgcctgtaactcaaccaccacggtgactttcttaccgttgtgtgcggcgtggatcatcgagtcgatgatgcgtgaatctttcgctacgcggtagatattgatttttatcgccagcacgctcgggtcgaacgacgcctgacgtagcagttccagcacgtgctcaaaggtgtgataaggataatagagcaacacatcgcgttcgcgaatggcatcaaaaccattgcggaactgggctttatcaaaccaaatatggcgtaaacgcggcagtggtttgttcaccagattggctttgccgacattggggaaattaataaagtctttaaaattatgataacgaccgccggggacgatggagtcgtagcgggaaatagtcagtttttcgcgtaacacttcaaccagagcattgggcatatcgcgctgataaacaaaacgcaccggctcagcagttaaacgctgcttgagactggaagacatcaactccatcagactggcttccatctcatgcactaaatcgtattcggcatcgcgggtcatcttcattgaataggcattcagtgcgtcataatcaaagaagcctttgaaaatatcatcaaggcagtaacgcagaatgttatccagaagaatcatcggcttgcgacgacgcggcgcttctggcggtaaattcacaaagcgcggcactttatctgatgggatctccagcagcgcgtaacggatggtatcgccacggataatttccaccgccagataggtgtaatcatctttcaggaactgcactaagtcagtgtcaggattgattaaaatcggcgtaatgtgctgacgcagatactgcttaaaataatgacgcagccagttttgttgattgacggagagctggcgttcattaatcaggaagatctggttgcgcgccatttccagcagtagctcgttgtagaggccgtcgaattcctgatcggctttcagcacacgggactgaattttgcccagtaaatggcgggaatgagagttagagccttgttcttcgctaataatgatgcgtcgcttcagttcagcgaagcggactttatagaactcatcaaggttattggaatagatccccaggaaacgcatcctttcaatcagcgggttagatttgtccgccgcttcctgaagcacgcgttcattgaacgataaccaactgagctctttttcgatgtatagcttttcctgacccattaccacttttactccgttttattcacgggacactgcctggatattatggcgagcaatattggcagatgtccaactatgccagaaaagggggaaaaaaactgctggagcttgcgatttacaggtgaattgaaaaacgccagcggcagagctggcgctttaactacgggggcattactcgtcggcagcgtagccctgcggcggcagacgttgaccatccagccacgcggcgttttcgtgcattttcagacgaccatcggcaaaccagctaatcaccagtggataaatagcgtgttcctgggtttgcacgcgggcggtgatgtcatcttccgtatcaccagcaaataccgggactttcgcctgtaaaataaccgggccaccgtccagttcatcggtgacgaaatgcaccgatgtaccgtgctcctcatcgccattttccagcgcctgacgatgggtgtgtaatccgggatatttcggcagcagagaagggtgaatgttcagcaaacgcccggcatagtgggagacaaacgccgggctgagaatgcgcataaaaccagccagcacgaccacatcgggtgcgtacatgtcgatttcatgaatcaactcccggtcataggcttcacgactgtcaaacgcgctggtgatgagcgtatgcgttgcaatacccgcctggcgggcgcgttcaaggccgaacgcgtcggccttattgctgaaaactgcccgtacggtgcctttaattttgttggttttgcaggcgtcaataattgcctgcaaattacttccgttgccggaaataagcaccacaatattcattattcgataaccacgcgttgttcggaatcagaggctttgatgataccgattttccacgcgttttcaccgttggcattgagcagggcgagggctttgtccacttccggagcaggcagggcaataatcataccgacgccgcagttgaaggtgcgatacatttcatggcgctcaacgttacctgccgtttgcagccagttaaacacttccggccactgccaggaagattcatcaatcactgcctgggtattatctggcaatacgcgcggaatgttttcccagaaaccgccgccggtcaggtgcgcaatggcatgcacatcgaccttttcaatcaacttcagcactgacttcacgtaaatgcgggtcggtgccagcagatgatcggctaatggcttaccatcaagttcggtggtttgcggatcacaaccgctgacttcaagaattttgcgcaccagcgaatagccattcgagtgcgggccgctggagccgagtgcaatcagcacatcgccgtcgctgactttagagccgtcaatgatttctgatttttctaccacgccaacgcagaaaccagcgacatcgtaatcttcaccgtgatacatccccggcatttccgccgtttcgccacccaccagtgaacagcccgattgcagacaaccttccgcaatgccgctgatcaccgctgaagcggtatcaacatccagttttccggttgcgtaatagtcgaggaaaaacagcggttccgcaccttgcaccaccaggtcattaacgcacatggcgaccagatcaataccaatggtgtcgtgacgttttaagtccatcgccagacgcagcttggtacctacgccgtcagtgccggaaaccagcacaggttcacgatatttttgcggcaatgcacacagcgcaccgaagccgcccagaccgcccatcacttccggacgacgcgttttcttcactacgcctttgattcttccaaccagagcattacccgcgtcaatatcaacaccggcatctttgtagctaagagaggttttatcggtcactgcttgggtccccacgcgttacttgcggtagaaaaataaaattcggcgcaattctaacagggaaagcaaacgtttgcgagactgctttacacaacctttttgcacgtcttttccccaggcgcgcggcgaaagaatacttgtaccagggcaaaggatcgttttcggatggaataatcttcttccataaccatttgaatataaaataactttatctcaaaccgttatcattttgactaaagtcaacgaaaataatattgccgccttgaagaaaggaggtataatccgtcgattttttttgtggctgcccctcaaaggagaaagagtatgaagatcgtggaagtcaaacacccactcgtcaaacacaagctgggactgatgcgtgagcaagatatcagcaccaagcgctttcgcgaactcgcttccgaagtgggtagcctgctgacttacgaagcgaccgccgacctcgaaacggaaaaagtcactatcgaaggctggaacggcccggtagaaatcgaccagatcaaaggtaagaaaattaccgttgtgccaattctgcgtgcgggtcttgggatgatggacggtgtgctggaaaacgttccgagtgcgcgcatcagtgtcgtcggtatgtaccgtaatgaagaaacgctggagccggtaccgtacttccagaaactggtttctaacatcgatgagcgtatggcgctgatcgttgacccaatgctggcaaccggtggttccgttatcgcgaccatcgacctgctgaaaaaagcgggctgcagcagcatcaaagttctggtgctggtagctgcaccagaaggtatcgctgcgctggaaaaagcgcacccggacgtcgaactgtatactgcatcgattgaccagggactgaacgagcacggatacattattccgggcctcggcgatgccggtgacaaaatctttggtacgaaataaagaataaaaataattaaagccgactttaagagtcggcttttttttgagtaaagcgcctataacacataatacagaggataatactatgacgcgccgtgctatcggggtgagtgaaagaccgccacttttacagacaatcccgcttagtttgcaacatttgttcgccatgtttggtgcaaccgtcctggtgcccgtcttatttcatattaacccggcgactgtactgttatttaacggtataggaacactgctgtatctcttcatctgtaaagggaaaattccggcttatcttggttccagctttgcctttatttcaccggtattgttactgttgccgttggggtatgaagttgcgctgggcggctttattatgtgcggcgtgctgttctgcctggtttcttttatcgtgaagaaagcggggaccggctggctggacgtgctgtttccacctgcggcaatgggcgcaatcgttgccgtcatcggtctggagctggcgggcgtagctgccggtatggcgggtttactcccggctgaagggcaaacgccagactccaaaaccatcatcatctctattaccaccctggcggtcacggttttaggttccgtgctgtttcgtggtttcctggcaattatcccgattttaattggcgtgctggtggggtacgcgctctctttcgcaatgggaattgtcgataccacgccgattattaatgctcactggtttgcgctgccgaccctctatacgccgcgcttcgagtggtttgccattctgactattctgccagcggcgttagtggttattgccgaacacgtagggcacctggtcgtaacggctaatatcgtcaaaaaagatctgctgcgcgatccaggtctgcaccgttcgatgtttgctaacggcttgtcgaccgtgatctccggtttctttggttccacaccaaacaccacttacggagaaaacattggcgtgatggcgatcacccgtgtttacagtacctgggttatcggcggtgcggcgattttcgctatcctgctttcctgcgtcggtaaactggctgctgctatccagatgattccattgccggtgatgggcggcgtttcgctgctgctttacggggtcatcggtgcttccggtattcgtgtgttgatcgaatcgaaagtggattacaacaaagcacagaacctgatcctgacttccgttattttgatcatcggcgtcagtggcgcgaaggtaaacattggcgcggcggagctgaaaggtatggcgctggcgaccatcgtcggtatcggcttaagtttgatcttcaaactgattagtatgctgcgccctgaagaagtggtgctggacgcagaagacgcggatataacagacaaataatgtaccgaccgggcagtgttgctgcccggttcaaacatcatgggattctgtggtaaacttctcgcgattttgtgaaatcctggttgaggtatctctgaacacaccggcacagctctctttgccactttatcttcctgacgacgaaacctttgcaagtttctggccgggggataactcctctttactggccgcgctgcaaaacgtgctgcgtcaggaacatagcggttacatctatctctgggcacgcgaaggcgcggggcgcagccatctgctgcacgcggcttgcgcggaattgtcacagcgtggcgatgcggtgggctatgtcccgctggataaacgcacctggtttgttccggaagtgctcgacggtatggagcatttgtcgctggtctgtattgacaacattgagtgtattgccggcgatgagttgtgggagatggcgattttcgatctctacaatcgaattctggaatcgggcaaaacacggttgttgatcaccggcgatcgtccaccgcggcagttgaatctgggattaccggatctcgcgtcgcgtctcgactgggggcagatctacaaattgcagccactttctgatgaagataagttgcaggcgctacagttacgcgcgcgtttgcgtggttttgaactgccggaagatgtggggcgtttcttgctgaagcggctcgacagagaaatgcgcacgttgtttatgacgctggatcagctggatcgtgcgtcgattaccgcgcaacgcaagctgaccattccttttgtgaaagaaattctgaagttgtagataaggtgtttattgtcggatgcggcgcgaacgccttatccgacctacgcgaagttaatccatagtattcgtaggccggataagacgcggcaagcgtcgcatccggcaatgtgcttcaactagcgatggagcacatcttaacccacgatttccagtacctgctccggtggacgaccaatccgtgctttgccattcgcgaccacaatcgggcgttccattagcttcggattatccaccatcgcctgaatcagcgcctcttcgctaagtgaactgtcagccaggttcagttctttataaagatcctctttttggcgcatcaattcacgagcgctattcatccccagcattttcagcaaatcacgcagcgttgccgcatcggcgggtgtctcaaggtagagcaccacttctggctccacgccgttttctttcagcaggttcagcgtttcccggctctttgaacagcgtgggttatggtagatttttacctgtttggtcattgttcttcctttaatgcgaattacatcttggtataaggcttaaagcgttcctgcagctggcgcaactggtcgatgcgcgcatcgtaacgcgcttgttgcaggctgcctaatttcacctgcgaactggcgctactcaacaaggaaatagcctgatcgagtcgcccggcgagcgcataaccttctgctcgcgcagccagttcctgatcgcggttatttagtgcggcttccgcctgtgccagtaaatcccagccgttgctgtcatctttattgttaaaagtgtagcgattcagaatattggccgcttcctgtggttgccccccttgcagataagcgttcgccaggttgagctgcaacaccggatcggtgcgcaaatcgcgggcatttttcaggcgattgatagcgtcattggctttgttttgcccaagatcgatatcggtagccagatcgagataccatgcgttgccaggttctgccgccagtaacggttgcagcgttttacgcgcttcgtcgtatttattggcttccatcgcctgtaaagcacgaccatattgcgccgctcgttgctgacgaacgtttcctttcgcccattcatccagcaaatcactggtgagttggttacgccctgaattgtacatccccagtgtgcgcacttttgccagatagaaatcttctgacgattgcaccactatcgggcgcatctgattggcacggttacgggcatcagccagacggctttccggtagtgggtgagtgagcagaatttctggcgggcgcgaagagtaacgcgcctgatcgagtaatttttcgaggaaggtcggcatcgcctgcggatcgaatcccgagcgttgcagcacctgaataccaatgcggtccgcttcctgttcattttgctgggtgaaactgatcatcccctggcgcgttcccgccagtgtaccggtcagcgccgccatccccgcctgcggactggccatcgccagtaaaatagaacctaacgcgccgacccaggtcagcggcgcgctgcgctgctgatcttccatcgctcgcgccaggtgacgttgggtgacgtgggagatttcgtgcgccataactgaagccagttgactttcgttatcggaataacggaacagggcagagtgcagcaccacgttgccgccaaagaaagcaaaggcgttaatttcatcgttgttgatcagaaagaaatgaaacggtgtcttaaccgaattggcatgcgaaaccagacgcattcctagcgaattaatgtattgcgttaacagcggatcattaattaacggcgcgctgccgcgtaactggcggacataatagtcgcccatctgcatttcctgaccaatggaaagtgtgcttcctgcggaggttcccatatccggcaaggtgtctgcgctgtcggcaaacgccggggctacctgaccaatggtcatagcagcaatgagggttgcaaccaggttttttttcaactgcctgaacataacctctatcctgtatttctggagatagtcatttgaccgatactgtgaaatatcgttcccaccgcgccgcctttgagtgtaacggcgaagattagcccactcaaatgacttttcagtttcctgaatccgtcataaaaagcgaagtcttttttgtgacatttcgatacaattgcggatcgcaatcccgctcttgaggttcagggaaggtctgtatgctcgaaatgttgatgcaatggtatcgccgccgttttagcgacccggaagcgattgccttgctggttattttggttgctggttttggcattatctttttctttagcggcctactcgcgccgttgctggtggctattgtgctggcctatttactggaatggccgactgtccgcctgcagtctattggctgttcccgcccttgggcgacatctatcgtgctgatcctgtttgtgggcatcctgctactgatggcgttcgtggtactgcctatcgcctggcagcagggcatctacttaatccgcgatatgccggggatgctcaataagctttctgactttgccgccacgttgccgcgccgctatccggcgttaatggatgcgggcattattgatgcaatggctgaaaatatgcgcagtaggatgctgaccatgggcgattcggtggtgaaaatttccctcgcctcgttggttggtttgctgaccattgccgtctatctggtgctggtgccattgatggtcttcttcctgctgaaagacaaagagcagatgctgaacgccgttcgccgggtgctgccgcgcaaccgtggactggcaggacaggtgtggaaggagatgaatcaacaaatcaccaactatatccgcggcaaagtgctggagatgatcgtggtagggatcgccacctggctggggttcttgctctttgggctgaactattcgctgctgctggcggtgctggtcggcttctcggtacttattccgtacattggcgcatttgtggtgaccattccggtggttggcgtggcgctattccagtttggtgctggcacggaattctggagctgcttcgcggtgtatctgattattcaggcgctggacggcaacctgttagtaccggtgttgttctccgaagcggttaacctgcatcctctggtgattattttatcggtggtgatcttcggtggtttgtggggattctggggcgtattcttcgctattccattggcgacgctgatcaaagccgtgattcacgcctggcctgatgggcaaatcgcgcaagactgaccttcagcgaaaaaattttaaacgagtgttgcagggcagtgagaagatttgagatgtgctggccgcaagcgcagccagcacggaatggagcaaagtaatcaggcgtgttctttcagccagttcagcacaacgtcgtggtgattgctggttttgaaatcgtcaaagacatgttcgattttgccatcagcgtcaatcaggaagctgatgcgatgaataccatcgtaggttttgcccatgaaggacttttcaccccagacgccgaattgttcgcacacctggtggtcctcatcagacaggagcgtaaagttaagcagctctttttccgcaaaacgggagagtttttcgggtttatcggtgctgatacccagcacatcaacgcccgcttttttcaactcatccatgttatcgcgtaagccgcaggcctgtacggtacagccgggggtcatggctttcgggtagaaataaaccagaacacgctgtccctggaagtcggtcaaattaacttgttctccgtcttgatccggcaagctaaatttcggtgcgatatcaccggctttcagtggattcattacttaactccatcctgttcatcatgttgggaataattgacgacgttaatactgccttgtgcattgagttctgtacatagggctttgaacgcttgctcaatatttgctgcgtccgcagatgcggggctgtgggcagttatctgaatatgcaactgcgcagccctttcattttcagcaggttgcgtgcgcgacaccagctccgcaatgttcatatgatgcgcgtcgaaaagtgctgtgaagcgttcaattaaatgcggggagtctgccacatcgacctgaacccagacagatgctggcattggcggacgcggacgcgccgtcgtgcgcttcatcacgattaaaagatccagctcggcacctttcaacggtaacgttgattcaatcagagtaatggcattccatgaaccggaaagcagcatgataaacgtgaactcttctcccagcatcgccaggcgactgtcttcaatattacagccgcaactactgacatgacgggtgatggtgttcactattccagggcgatcggcacccaacgcagtgatcaccagataatgttgcgatgacagtgtcaaactggttattccttcaaggggtgagttgttcttaaggaaagcataaaaaaaacatgcatacaacaatcagaacggttctgtctgcttgcttttaatgccataccaaacgtaccattgagacacttgtttgcacagaggatggcccatgttcacgggaagtattgtcgcgattgttactccgatggatgaaaaaggtaatgtctgtcgggctagcttgaaaaaactgattgattatcatgtcgccagcggtactttggcgatcgtttctgttggcaccactggcgagtccgctaccttaaatcatgacgaacatgctgatgtggtgatgatgacgctggagctggctgacgggcgcattccggtgattgccgggaccggtgctaacgctactgcggaagccattagcctgacgcagcgcttcaatgacagcggtatcgtcggctgcctgacggtaaccccttactacaatcgtccgtcgcaagaaggtttgtatcagcatttcaaagccatcgctgaacatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattaggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaaagtttagggagatttgatggcttactctgttcaaaagtcgcgcctggcaaaggttgcgggtgtttcgcttgttttattactcgctgcctgtagttctgactcacgctataagcgtcaggtcagtggtgatgaagcctacctggaagcggcaccgcttgcggagcttcatgccccggctggaatgattttgccggtgacctccggcgattatgcaatcccggtgaccaacggtagtggtgctgtcggtaaggcgctggacattcgtccaccagcccagccgttggcactggtttctggcgcgcgtacccagttcacgggcgataccgcttcattgctggtggaaaatggtcgtggcaatactctgtggccgcaggtggttagcgtgctgcaggcgaaaaactacaccatcacccaacgtgatgatgctggtcagacactgaccaccgattgggtacaatggaaccgtctggacgaagacgagcagtatcgtggtcgttatcaaatctctgttaagccgcagggttatcagcaggcggttacggttaaactgctgaacctggaacaggcgggcaaaccggttgcagacgcggcttccatgcagcgttacagcacggagatgatgaacgttatttccgccggtctggataaatctgccactgacgccgcgaacgctgcgcaaaaccgtgcctccaccactatggacgtacaaagtgcagctgatgacaccggtttaccaatgctggtcgtacgcgggccgttcaatgtggtttggcaacgtctgccagctgcgctggaaaaagtgggcatgaaagtgaccgacagcacccgttcgcagggcaacatggccgtaacatataagccgctgtctgacagcgaatggcacgaactgggcgcgagcgatccaggtctggcatccggtgactataaactgcaggttggcgatttagataaccgcagcagcctacagttcatcgatccgaaaggtcatactctgactcagagtcagaacgacgcgctggtagctgtcttccaggctgcgtttagcaagtaaaaatacagggctggagtcatccggcccttttttctgatatgatacgcaaacgtgtgcgtcgacagaaaaacgcgattttagcggtaattcgcacgaaatttgtttgtcggacgtaggtcggataaggcgttcacgccgcatccgataaaacatccggcacaccagacagcaaaagattttaaaacgttaattcacacccaggagtgataaagatgcaaaagcaagctgagttgtatcgtggtaaagcgaaaaccgtatacagcacggaaaacccggacctgttggtgctcgaattccgcaatgatacgtcagcaggggatggcgcgcgcattgagcagtttgatcgcaaaggtatggtgaacaacaagttcaactacttcattatgagcaaactggctgaagcgggtatcccgactcaaatggagcgtctgctctccgataccgaatgtctggtgaaaaagctggatatggtgccggttgagtgtgtcgtgcgtaaccgtgctgctggctctctggtgaaacgtcttggaatcgaagaaggtattgagctgaacccgccactgttcgatctgttcctgaaaaacgacgccatgcacgatccgatggtcaacgaatcttactgcgaaacctttggctgggtgagcaaagagaacctggcgcgtatgaaagagctgacctacaaagcgaacgacgtgctgaaaaaactgttcgatgatgctggtctcattctggtcgacttcaagctggagtttggcctgtacaaaggtgaagtggtactgggcgatgagttctccccggacggcagccgcctgtgggacaaagaaacgctggagaaaatggacaaagaccgtttccgccagagcctcggtggcctgatcgaagcctatgaagccgttgcccgccgcctgggtgtacagctggactgatttttctgttcatcatcttgccgtgctgctggcacggcaagacaaccgctctcataagatgtgcattgaacgctcattcctccgccatttcatcccgctttcctgtggtaatcttcctctgaaccacctacgatcatttctataatgaatataatgttgaggtatctatgcgttggcaagggcgacgtgaaagtgacaatgttgaagacaggcgcaatagctccggcggtccgtcaatgggcggtcccggttttcgcctgccaagcggtaaaggcgggctgattttactgatagtcgtgctggttgcaggctactatggcgttgatttaaccgggttgatgaccggacagccggtttcccaacagcaatcaacgcggtcaattagccctaatgaagacgaagccgcaaaattcacctcggtgattctggcaaccacggaagacacctggggacagcaattcgagaagatgggtaaaacctatcagcaaccgaagctggtcatgtaccgtggaatgacgcgtaccggctgcggggcgggccagtccataatggggccattctattgcccggcggatggcacagtttatatcgatctctccttctatgatgacatgaaagacaaacttggcgcggatggcgattttgcccaggggtacgttatcgctcatgaagtcggtcatcatgtgcagaaactgttaggcatcgagccgaaagttcgtcaactgcaacaaaacgcgacgcaggcggaagtaaaccgcttatctgtgcgtatggaactccaggccgactgttttgccggtgtctgggggcatagtatgcagcagcaaggtgttctggaaaccggcgatctggaagaggcgctgaacgcggcgcaggccatcggcgatgaccgtttacaacagcaaagtcaggggcgagtagtaccagacagtttcacgcatggcacttctcagcaacgctacagctggtttaaacgtggtttcgacagcggcgatccggcacaatgcaatacttttggtaaaagcatttaacttccggggcagggatggctgaactgactgcgcttcacacattaacagcgcaaatgaaacgtgaagggatccgccgcttgctggtgttgagcggggaagagggttggtgttttgatcatgcgcttaagttgcgtgatgccttacctggcgactggctgtggatttcgccgcagccagatgctgaaaaccactgttcaccctcggcgctacaaactttacttgggcgcgagttccggcatgcggtattcgacgcccgccaaggctttgatgccgctgcctttgcggcacttagcggaacgttgaaagcgggaagctggctggtgttgttactccctgtatgggatgagtgggaaaaccaacctgatgccgactcgctgcgctggagtgattgccctgaccctattgcgacgccgcattttgtcctgcacctcaaacgtgtacttacggcgaataacgacgctatcctctggcggcaaaaccagccgttctcgttggcgcattttactccccgtactgactggcaccccgctaccggcgcaccacaaccagaacaacagcaactcttacagcagttactgaccatgccgccgggcgtggcagcggtaactgctgcgcgtgggcgcggtaagtcggcgttggcagggcaactcatttctcgtattgcgggcagtgcgattgtcaccgcgcccgcaaaagcggcaacggatgtactggcacaatttgcgggcgagaagtttcgctttattgcgccggatgccttgttagccagcgatgagcaagccgactggctggtggtcgatgaagccgcagccatacctgcgccgttgttgcatcaactggtatcgcgttttcctcgaacgttgttaaccactacggtgcagggctacgaaggcacgggacgtggttttttgctgaaattttgcgctcgctttccgcatttacaccgttttgaactgcaacagccgatccgttgggcgcagggatgcccgctggaaaaaatggttagtgaggcactggtttttgacgatgaaaacttcacccacacaccacaaggcaatatcgtcatttccgcatttgaacagacgttatggcgaagcgagccacaaacgccgttaaaggtttatcaattattgtctggtgcgcactaccggacttcgccgctggatttacgccgcatgatggatgcaccagggcaacattttttacaggcggctggcgaaaaagcgattgccggggcgctgtggctggtggatgagggcggattatctcaagaactcagtcaggcggtatgggcaggttttcgtcgcccgcggggtaatctggtggcccagtcgctggcggcgcacggcagcaatccactggcggcgacattgcgcggaaggcgggttagccggatagcagttcatccggctcgtcagcgggaaggcacaggtcagcaactgattgctggtgctttgcaatatacgcatgacctcgactatctttcggtgagttttggttacaccggggaattatggcgtttctggcaacgctgcggttttgtgctggtgcgaatgggtaatcatcgtgaagccagcagcggttgctatacggcgatggcgctgttaccgatgagtgatgcgggtaaacaactggctgaaggtgagcattaccgtttacgtcgcgatgcgcaagctctcgcaaagtggaatggcgaaacgcttcccgttgatccactaaacgatgccgtcctttctgacgacgactggcttgaactggccggttttgctttcgctcatcgtccgctattaacgtcgttaggttgcttaatgcgtctgttacaaaccagcgaaatggcattaccggcgctgcgtgggcgtttacagaaaaacgccagtgacgcgcagttatgtaccacacttaaactttcaggccgtaagctgttactggttcgccagcgggaagaggccgcgcaggcgctattcgcacttgatgatgttcgcactgagcgtctgcgcgatcgcataacgcaatggcaattttttcactgactccttcaattttctcccatggtcattgtgagtcagcggcgtaaaattaatgacatcagttaaggagttcgccatgaaacatgaccattttgttgttcaaagcccggataaaccagcacaacagttgttactgcttttccacggtgtcggggataacccggtggcaatgggggaaataggtagctggtttgcgccgctgtttcctgatgcgctggtggtgagtgtcggtggcgcggagccgagcggtaatccggcggggcgtcagtggttttcggtgcagggtattacggaagataatcgccaggcgcgtgtgaatgccatcatgccgacgtttattgagacggtgcgctactggcagaaacaaagcggagtaggggctaatgccacggcgctaatcggtttctcacaaggcgcgattatggcgctggagagcattaaagccgaaccgggccttgcttcgcgcgtcattgccttcaacggacgctacgcgagcctgccggaaaccgcgtctacagccacaacaattcacttgattcatggcggtgaagatccggttatcgatctggcgcatgcggttgcggcgcaggaagcgttaatcagtgccggtggcgatgtgacgctggatatcgtggaggatttaggccatgcgatcgacaatcgcagtatgcaattagccctggatcacttgcgttataccattccgaaacattatttcgacgaagcgctaagtggcggtaagcctggcgatgatgatgtgattgaaatgatgtaataatagccgggtaggcctgataagactgtatcaggcatcatggccggatgcggcgttaacgccttatccggccacttagcttacttcttcggttgatcctttttcggccagtcgtcgtcatcgtcccacttatcgttgaaatcacgatgcgggggaagctccggcttgttggcgagaaatttcttatggtcgacgcgcttgagatctttaatcacgttcagcaggacgcctaccaaaaagacaatcaccagaatccaccaatatttagccagccagtccatgcttatttcctcttgcggaaccactcatcaggcgacgagctgttccatgatacgttgatacatacgggcaagtagctgcaggtcggcagcgttcacacattcattaattttatgaatcgtggcattgaccggcccgagttccaccacctgcgcccccatgcgggcaataaagcgcccgtcggacgttccgcctgtggtcagtagctgcggtttaatttcattatagtgctcaaccgcgttaacgaccgcatccaccagtttaccgcgcgcggtcaaaaatggctgcccggaaagccaccaatccaccgtatagcgcagttgatgtttttcaagcagggcaagcacctgctctttgatcatctcatccgtcagttcggtgctaaagcggaagttaaactgcacaaacagttcacctggaataacgttgttactgcccgttcccgcctgaatattggcaatctgcatactggtcgccgggaagaattcattaccctgatcccactcaatagccactaattcattaatgaaaggtgctgcgcgatgtaccggattgtcagccagatgtgggtaggcaacatgcccctgaacgccatgaatggtaaggttgcaggttaacgatccgcgacgaccatttttcaccacatcacctaccacttcgatactcgacggttcgccaaccagacagtaatcgagacgctcattacgcgccattaacgcttcgacgacttttaccgtaccattgtgggcactagcttcttcatcagaggtgatcagaaatgccagtcgccccgtatggttgggatgttgtgcgacaaagcgttctgccgctactaccatcgccgccagcgagcctttcatatctgccgcaccgcgcccgaataacatgccgtcacgaatggttggttcaaacggcggattgatccaacgatcggcgtcgccaggcggcaccacgtcggtatgcccggcaaaggccaatgtttcaccttgcccacgccatgcccaaaaattctgcgtatcggcaaagtccatgcgttcaacggtaaaaccgatcgcctgcaaacgttcaatcaacaaagcctggcatcctgcgtcatcaggactcagggaagggcggcgaataagctgttgtgtcagctcaataaccgggcacgacatagactacacctcatggaaaaattgctgataactggattcactgaaacccagcagcataggcttaccaggcgcgcagagcaatggacgtttgataattgcaggcatttcagtcattaatgtcgccgcagaggccgcatcggtgattttattgcgggtggtttcgtccagtttacgccaggttgtaccacgggtgttgagtaacgcttcccagcctaattcgttgataaaaccgttcaataattcgctgtccaatccatcgacgcggtaatcatgaaaacgatagtcgatgttattagcttccagccaacggcgagccttcttaatggtgtcacaatttttgatgccgtaaagtgtaaccataatgaatcctttttcgatttatgagaataaatactcatttaaaggtgaaaacattttgcctgcaaatgattatcaggaaatataacattatcgaagtattcaaattaacaaccattaaataacattaaacatttttaacgtaaacattaagaatattcatcttgttatctgtctgtattttaaccagaattaaatcagtattagatgccgtatgaatatctcgaaatgttgcggtgcatcacatacaaatcatcaccgcaggaccatagtatttacataaggtttgtcccccggaggtagtcatcacagcaatcgagtaaattagcttcaccacggtatattgtttccgtagaatacccataattataagagaggttgttatgattgaacgtgaactggggaactggaaagactttatcgaagttatgcttcgtaagtaattcctgagacaaagtacaaacagcaagaacccgctgagcaggttcttaatcggaaagttgaaaagggcgacacattggcatgtcgccttttttattgcttattccgggcgcggcttcagcgggaagcggcggcgcaccagcacaaagaacagcggcacgaagtaaatagccagaatagtggccgaaatcatcccgcccattacgccagtacccaccgcatgctgaccaccggaaccggcacctgtgctggttgccattggcaatacgccgaagataaatgccagcgaggtcatcagaatcgggcgtaaacgctgacggcaggcgtggagcgtcgcttcaaacaggtcgtggcctttttggttcatctcgttagcaaactcgacgatcaggatagcgtttttcgccgataaaccaatgaccgttaacagacccacctggaagtaaacatcgttttccagcccgcgcatccaggttgccagcagcgcgccgataacccccagcggcacgaccagcattaccgagaacggcaccgaccagctttcatacaatgccgccagacacaggaataccaccagcaaggaaatggcgtacagcgccggagcctgcgcgccggaaagccgctcctgatacgacatcgccgtccactccagaccaaagccgtttggcaactgcttcactaacgattccataatatccatcgccgtaccggtactgacccccggtgcggcttccccaacaatctcaaccgcagaataaccattatagcgttccagacgcggcgagcctgtctcccagcgtgaggtcgcgaaagcagagaagggcaccatgccgccatctttatttcggacataccagagattgatgtcatctggcagcatgcgatacggcgcagctgcctgcacatagactttcttcacgcgaccgcgatccataaagtcattcacatagctagaaccccaggcggtttgcagtgtgtcgttaatatcgtcgatagcaacgcccagcgcctgagctttacgctggtcgatatcaatctgcaactgcggactgtcgtcgaggccgttatggcgcacacgggttagctccgggttttccgctgccagcgccagcaactggtttcgtgctgccatcagcgcatcgtgacccgctccagcgtggtcctgcaactccatatcaaaacccgcagaacttccaagaccgctaattgctggcgggctgctggcgataacgcgagcttctttaatcttgttaaacgccttcgttgcacgctcgataatggcaaacgaggtgccggtcttactgtcgcgttcgctccagtctttcaggcggataaacattcgcgccacgttttgcccgttacccccagggccagaacccacggtggcaaacaccgacatgatgttgtctttttcatgggtgaagtaatatttctcgatttgctcaacgactttcagggtctgttgctgggttgaaccgctgggcaactgtaccgaggtagtaaacatgccacggtcttccagcggtaagaacgacgtcggcaaacgcaggaacaggaacaccatgccgccaagcagcaggacataaatcacaatccagcgcaggctacggtggagaattttcgccacccctttttcgtagcgttcggcgttgcggttaaacatctggttaaaccaggcaaaaaagcctttttgcccgtgatgctcaccttttttcagtggcttaagtagcgtggcacacagagcaggagtgaggatcatcgctaccagtactgacagcaccatcgccgcaacaatggtaatagagaactggcgatagatggcaccggtggtgccgccgaagaaggccattggcacaaataccgccgaaagcaccatcgcaatcccgaccagtgccccctggatctgccccatcgatttacgtgtggcttcgcgaggagtgagtccttcctcactcataatacgttcgacgttttccaccaccacgatggcatcatccaccagcagaccgatcgccagcaccatcgcgaacatggttaaggtgttgacactgtaaccgaaggcgtaaagcacggagaaggttcccatcaacaccactggcacggcgatagtgggtatcagcgtggcgcggaagttttgcaggaacagatacataacgaggaaaaccagggcgatagcttccagaagcgttttcaccacgtcttcaatggaggctttaacaaacgaggtggtttcatacgccaccttgtattccagtccgtgtggaaaatactgcgccagctcgtcgagacgattgagcaccagctccgctgtcgccatttcgttcgcgccggaggccagtttaacccccagcccggaggctggcttaccattgaagcggctaagataatcgtatttctccgcccccatttcgacggtggcgacatcgcccagccttacctctgagccgtcctgattcacccgcaaggtgatatcgcggaactgttctggtgtttgcagcagtgactgggcgttaatggtggcgttgagcgcctgcttatcgacggaaggcgtaccaccaagttgcccaaccgcaatctgcgcgttctgtgattcaatggcatcggtgacatctttagccgtcatctggaaactgttgagtttcgccgggtccagccagatacgcatggaatattgcgaaccataggcatcgatatccccgacgccattcacgcggcttaacgggtcctgaatattactggcaacataatcggcaatatcctgtttatccatcgaaccatcggtagagacgaaggcaatggtcagaatgttggtatcgccggttttacgcaccgtcacgccctgattttgcaccgcctgcggtaactttcgcatggctgattgcagctggttttgtacttgctgcacggcttcgtccggatcggtgcctgctttaaaacttaacgtgacagatgcctgaccggtgccgctgctctgagatgacatatacatcagattatcgaggccggtcatattttgctcgataacctgggtcacggtgttttccagcgtctgggccgatgcgccgggatagttagcggtcactcgcacattcggtggcgcgagatcggggtattgttcaacgggcaatgaaaaaatcgccagggtacctgtcagacacaacaggattgccagcacccaggcaaaaatggggcgatcaataaagaaattcgccattaaaagaggacctcgtgtttctgcgtatcgttgtaggcttggcttgcttcactgtagcggcaaggtacgagccaatcgtggagaaaaaaaggagttaatgtaaattatcatgcccttttatactgaaccttaagtgccactattctttggtcaataagaggcattatatcagctgactttcctcaccctccgcagagcgaaagctaatactcactaacgtgccgccgccggaaggttgtgaaaaagtcagcgtcccacccaatctttccgcgcgttcgcgcatgatattcagaccataatggccttcgggttctttcggttcaccgatgccaatcccgttgtcgcgaatatagactgtgtgattgccatccggcgcggtgacgcagctaacggcgatttcgctggcgttggcgtgcttcatcgcattcagcaccgcttcgcgaattatttgcaacaaatgcacctgcatttgcgcatccagcgccagggttggcagacggcagtcgagggtcagtttggcgctggtttgattttgtaacgtatccagcatttccctcaacgcggaggggagatccgcctgctgcagcgtcaggcggaaagtagtcaacagctcgcgtaactgccgataagcatcattcaacgcctgggaaaaatcggccatgatactttgtgcggtggcgttatcttccggtatcgaacgcttcagtaacgtcaactggatacgtaagtaagaaagtacctgagccagtgagtcgtgcaattcgcgggcgatggtcgcacgttcttccatcaacaataactgctgaaaatgcttctgcgcctgattaaagtacaaaccgcgtcccagcatcgacgaaacgctgttaagcagcggttctgatgatgaaacgtgactattttgccagtgcagttcgccgtaaaccgtctcttgcattgtcaccggtaaaatctgcatcggcaattccgggtttggctgcccttcgctaatccgccagttgtcaccgacatttaactccagatattcagccgcttcattgtcgcgaacaatctgcaaaatatggcggaaacaatgcacatcaatctggctggtgtttagcgcctgcgaacactgatacaacacctccagacgacgcttggcctcgtggagatcgcgggtcttttcttctactgacgcctccagcgaacggtacaatttatgcagctcgctcgacatctggttaaaggtttttgcaagcaggccaagctcattcggcaggctggtatccagcggcggcgagtcgaactgcccgtgttcaatacgctgactggcggtaaccagctgattcagcggggcaaccacctgatggcgtatgcgacgcaaagtaaaaaagaccagcgtgaaaataccgatgccgccagccagggaaatcgccaccaccagcagcattttgcgttcagcgtagtgctgtaaagccagtacgaacaggtctatctgattaacataattattaatattggcctgataccacggcaaatcacccttgctgagccgattattcatctccagccagttggcattcagatgcgcatagcgggtttttactgcctctggcacataccagacgttgagattggttaataccggtgaatgcagtgcctgctgaaataactggcgatgtgcattgagttgtggactgccactttgcaaatcgtagcccaggcggtaactctgcatacgcagcgatccggcaatattgatagcctcagcgtcgcgcaaactgctcgccagcgttagcagagcgatacccgtggaaagaatcgacagcagcacaatgtaaaaaaaggcccgggccagactggccgagacgggtcgtttaacaatcacacgcgtcttctccacaaaaaatcattaatgttccagttcgctgaaacgcaatttagtcagtgatgggattatttgatctgccacagtttatagcgaaatagttacttattctgggcacatgaacattgccgattcccctgtaagtcgggtaataacaacactcatataaagaataaggtttttacaaccaaaaaagaaggtcgttatgaatcgttttattatggccaacagtcagcaatgtctgggttgtcatgcttgtgaaatcgcctgtgtcatggctcacaatgacgagcaacatgtcctgagccaacaccattttcatccccgaattacggttatcaaacatcagcagcaacgtagtgcagtgacctgtcaccattgtgaagatgcgccctgcgcccgtagctgccctaatggcgcaatcagccacgttgatgacagcattcaggtcaatcagcaaaagtgtattggctgtaaatcctgcgtggtggcctgtccatttggtacgatgcaaatcgttctgacacccgttgcggtaggaaaagtaaaagccacggcgcataaatgcgacctttgtgcagggcgcgaaaacggtcctgcctgtgtcgaaaattgcccggcggacgcgctgcaactggtcactgacgccgcactctccggcatggcgaaatcccgccgcttgcgcaccgcacgtcaggaacaacaaccgtggcatgccagtaccgcggcgcaagaaatgccggtaatgagtaaagtcgagcaaatgcaggcaacgcccgcgcgtggcgagccagataaactggcgattgaagcgcgcaaaaccggttttgatgaaatttatctgccattccgtgccgatcaggcacaacgggaagcctcgcgctgccttaagtgcggcgagcacagcgtttgtgaatggacctgcccgctgcataaccatataccgcagtggattgaactggtgaaagccggaaacatcgacgccgccgtcgagctttctcaccagaccaacaccctgccggaaattaccggacgcgtttgcccgcaagaccgtttgtgtgaaggtgcctgtactattcgcgatgagcacggcgcagtaactatcggtaacattgaacgctacatttcagatcaggcgttggcgaaaggttggcgtcctgacttaagccatgtcaccaaagtggacaagcgggtggcgattatcggtgcgggtccggcagggctggcctgtgcggatgttttgacccgcaatggcgtggcggtgacggtgtacgatcgccatccagaaatcggtggcttgctcactttcggcattccttctttcaaactggataaatccctgctggcacgccgtcgggaaatcttcagcgcgatggggattcacttcgaactcaattgtgaagtgggtaaagatgtctctttgaattcgcttttggaacaatacgacgcggtcttcgttggcgtaggcacttaccgctccatgaaagcgggtttacccaatgaagatgcgccgggcgtttatgacgcgctgccgttcctcatcgccaatactaaacaggtgatgggactcgaagagctaccggaagagccgtttatcaatactgccggacttaacgtcgtggtactgggcggcggcgacaccgcgatggactgtgtgcgtactgcgctgcgccacggcgcgagtaacgtcacctgcgcttatcgtcgtgatgaagctaacatgccaggctcgaagaaagaggtgaagaacgcccgtgaagagggggccaacttcgaatttaacgtccagccggtggcgcttgaactgaatgaacaaggtcacgtctgcgggattcgtttcctgcgcacgcgtcttggcgagccggatgcccaggggcgtcggcgtccagtgccggtggaaggcagtgaatttgtcatgccagccgatgcggtgattatggcgtttggcttcaatccgcacgggatgccgtggctggagtcgcacggtgtaacggtagacaaatggggccgcatcatcgcggatgtggaaagccagtaccgttaccagaccacgaatccgaaaatcttcgccggtggtgacgccgtgcgtggtgcggatctggtggttaccgcaatggcagaaggacgtcatgcggcacaggggatcattgactggctgggcgtaaaatcagtcaaatctcactgatagcctgcgcagacaaacccgacttcacagcgtaagataattgttcatttcgcgctgtggagtcggtatgacgcaacaaatcaccctcgttaaagacaaaattctctccgataactatttcaccctgcacaacattacttacgatctcacgcgcaaagatggcgaagttatccgccataaacgtgaagtttacgatcgcggtaatggtgcgacgatcctcctgtacaacgcgaagaaaaagaccgtggttctgattcgccagttccgcgtcgctacctgggttaatggcaatgaaagcgggcaactgattgaaacctgcgccgggctgctggataacgacgaaccggaagtgtgcattcgcaaggaagcgattgaagagacgggctatgaagttggcgaagtccgcaaattatttgaactgtatatgtcgccaggcggtgtgactgagctaatccacttttttatcgccgaatacagtgacagccagcgcgctaacgccggtggtggtgtcgaagatgaagatattgaagtgcttgagctgccgttcagccaggcgctggagatgattaaaaccggcgagatacgtgacggtaagacggtgttattgcttaactatttgcaaatgtcacatttaatggactgaaaaataacaataatatttcgttgtttattattggctcaatccgacaaatccgattgagccgcgctacctgcgcaacgaagatacgacttgtgctgtttgtttgaacttctggggtcgtaccgtccatgcgatatcgcattttccttctcttttttttcgttttgttgccgatgtctttggtgtgggcggcaccagcgcaacgggcgttttccgactggcaggtcacctgtaataatcaaaatttctgtgtagcgcgcaatacgggcgatcataatggactggtgatgaccctgagccgcagcgccggggcgcataccgatgccgttttacgtattgagcgcggcgggttgaagccgccggatgcgtcagaaggggagatagcgccacggctgctgttagatggtgagccgttggcgttaagtggtgacaagtggcggatttcaccatggttattagtaaccgatgatacggcaaccatcaccgcgtttttgcagatgattcaggaagggagggcgatcaccttacgcgacggcaatcagactatttctctgagtggcttaaaagcggcgttgttgtttattgatgcccagcaaaagcgcgttggcagtgagaccgcgtggataaagaaaggggacgaaccgccgctcagcgtaccgccagcgcctgcgctgaaagaggtcgcggtggttaacccaacgccgacgccactctcacgcgaagaacgtaacgatttgctggattatggaaactggcggatgaatggtctgcgctgttcgcttgatccgttacgtcgtgaggtgaatgtcactgcgctgaccgatgataaagcgctgatgatgattagctgtgaggcaggggcctataacaccattgatttggcatggattgtgtcgcgtaaaaagccgctggcctcgcgcccggtacggttgcgtttgccgttcaacaacggtcaggagaccaatgaactggaactgatgaacgcaacattcgatgaaaaatcgcgtgaactggtgaccttagcaaaagggcgcggattaagcgattgtggcattcaggcgcgctggcgctttgacggtcagcgttttcgcctggtgcgttacgccgcagaacccacctgcgataactggcatgggccagacgcctggcccacgttgtggatcacccgttaaacaaaatggcggggacatgtagaccggataagacgcaccagcgtcacatccgacaatcagcatccggcgatcaccatcaggcacctttcactcccagtaccttatgcgcttttgccacaatattctcggcggtaaagccaaagaacgggaacagcttatccgccggagcagattccccataacctgtcatcccgacaattgcccctttcagaccaacatatttgtaccagtaatcggcaatacccgcttctactgccacgcgggcagaaacatttgaaggcagtaccgactcgcgatattcctcatcctgggcatcgaaaatatcggtcgaaggcagggaaaccacgcgaacattgcgaccttctcccgctaatttctctgccgcttgcagggtgatttccatctctgaaccggtggcaatcagaataatatctggcttaccgccgctgtctttcagcacataaccgccacgagcaatctctttaacctgatccggtgttcgttctacctgtgccagattctgccttgagaggatcagtgctgtcggtccgttgtggcgctcaaccgccagcttccagccaaccgccgcttccacctgatcgcacggtcgccaggtgctgaaatttggcgttaagcgcagactagccagttgctcaacagcctggtgcgtcggaccatcttcgcccagaccaattgagtcgtgggtataaaccataatctgccgcgctttcatcagtgccgccatccgcgcggcgttacgggcgtattcaacaaacatcaggaacgtcgcggtatacggcacaaagccgccgtggtgcgcgatgccgttggcgatagcggtcataccaaattcacgcaccccgtagtgaatgtagttgcccgccggatcttccttcagcgaaacagaacctttccagatggtcaggttgctgggagccagatccgccgaaccgccgagcaactcaggcagcatcggcccgtaagcgttaagcgtattttgcgaagccttacgggtagcgattttcgccggattcgcctgcaactcattgatatatttctgagtcgttttctcccagtccttcggcaaaccgccgctcatccgacgggtaaactcttctgccagttgcggatgagcctttttataggcggcaaacttctcattccagcgctgctgcgctttttcgcctttttcgcgggcattccaggcgtgataaatctctttagggatctcaaatggcggatggtgccagcccagtttttgccgtgccagcgccacttcttcttcccccagtggtgcgccgtgcgcctcttccttacctgctttattcggcgaaccaaagccaatcaccgtacggcagataatcagcgacggcttatctttcacgctttgcgcttcaaggatcgcttccttcaccgcctgcggatcgtggccgtcgatctcgtggaccacatgccagtgataggcttcaaaacgttttgccgtatcgtcggtaaaccagccttcggtttcaccgtcgatggaaataccgttgtgatcgtaaaaaccaatcagcttgcccagccccagcgtgcccgccagcgaacagacttcgtgagagataccttccatcaggcagccgtcgcccataaacacataggtgaagtgatcgacaatttcatgatccggctgattaaattgcgccgccagcgtacgctctgctaccgccagcccgacggcgttcgccaaaccttgtccaagaggaccggtggtggtttcaacacctggcgtatagccgatttccgggtgaccaggggttttcgaatgcaactgacggaagttcttcagttcttccagtggcaggtcgtaaccggtcagatgcagcaaactgtagagcagcatcgacgcgtgaccgttggaaagaataaagcggtcacggtcataccaggttgggtcggtggggttatgtttaagaaaatcgttccacagcacttcggcaatatcagccatgcccatcggcgcgccgggatgaccagaattggctttttgtaccgcatccatactgagtgcgcgaatcgcattggcaaggtcttttcgggacatataacactccgtggctggtttatagtttggcggcaagaagatcttccagtttgcgttgatcaacggcgaacagacgaatgccttcagacagtttttctaccgccatcgcatcctgattgtgctcccaacggaactccgcttcgctcatgggagctgggcgtgggaacgtctgagaaggtgggattaatttacgtaccactggcgaaactttttcctgtagctccttcagcaaattcggtgcgatagtcagtcggtcgcagccggttaaggcgaggatttgttcggtgcgacggaagctcgcgcccatcacaatggtttcatagtggtgttgcttatagtagtcgtagatattgcgtactgatttaacgcctggatcttcttccaccacatacgggtccatcggcttgcgtgcctgataccagtcataaatacgcccgacaaacggcgaaatcagaaaaacgcctgcttctgcacaggcccgcgcctgtgcaaaagaaaacagcagcgtcaggttgcagttgataccttctttttccagctcttctgccgcgcgaattccttcccaggtcgaagccagcttgatcagaatgcgcgatttctcaacgccttgttgctgatacaagtccaccagatggcgcgccttctcaatactcttttctttatcaaaagagaggcgtgcatcaacttctgttgacacgcgaccgggtacgattttgagaatttcagcaccgaaattgaccgccagtttgtcacacgctgcgaccacctgttgttcctgggtcttgccattttttttaccccaggcgatagcatcgtctattaaatgctcatattgtgataatccggcagccttgagtaacagcgaaggattggtggtggcatcctggggatgataatggcgaatggactcaatatcgccgctgtctgccacgacagtggtgaactgtttgatgccgtctaactcgttcataggaaatactccttgaaaagtaaagtgttagatgagtgcgttaattcacacttctgagaaatttcgctaaacgcatcaaaaaagcatagcagacaggcatggtattgctggattaagcaggtaacatcagtgttataggattattaccaaaacattatattaatggtgagagtttggacttgctcaaagtctgtagactccggcagggtaataatgtgcgccacgttgtggacaggggctgttgcccacacactttatttgtgaacgttacgtgaaaggaacaaccaaatggatgaccagttaaaacaaagtgcacttgatttccatgaatttccagttccagggaaaatccaggtttctccaaccaagcctctggcaacgcagcgcgatctggcgctggcctactcaccaggcgttgccgcaccttgtcttgaaatcgaaaaagacccgttaaaagcctacaaatataccgcgcgcggtaacctggtagcggtgatctctaacggtacggcggtgctggggttaggcaacattggcgcgctggcaggcaaaccggtgatggaaggcaagggcgttctgtttaagaaattcgccgggattgatgtatttgacattgaagttgatgaactcgacccggacaaatttattgaagtcgtcgctgcgctcgaaccgaccttcggcggcatcaacctcgaagacattaaagcgccagaatgtttctatattgaacagaaactgcgcgagcggatgaatattccggtattccacgacgatcagcacggcacggcaattatcagcactgccgccatcctcaacggcttgcgcgtggtggagaaaaacatctccgacgtgcggatggtggtttctggcgcgggtgccgcagcaatcgcctgtatgaacctgctggtagcgctgggtctgcaaaaacataacatcgtggtttgcgattcaaaaggcgttatctatcagggccgtgagccaaacatggcggaaaccaaagccgcatacgcggtggtggatgacggtaaacgtaccctcgatgatgtgattgaaggcgcggatattttcctcggctgttccggcccgaaagtgctgacccaggaaatggtgaagaaaatggcccgtgcgccaatgatcctggcgctggcgaacccggaaccggaaattctgccgccgctggcgaaagaagtgcgtccggatgccatcatctgtaccggccgttccgactacccgaaccaggtgaacaacgtcctttgcttcccgtttatcttccgtggcgcgctggacgttggcgcaaccgccatcaacgaagagatgaaactggcggcggtacgcgcgattgcagaactggcccatgcggaacagagtgaagtggtggcttcagcgtatggcgatcaggatctgagctttggtccggaatacatcattccaaaaccgtttgatccgcgcttgatcgttaagatcgctcctgcggtggcgaaagcggcgatggagtcgggcgtggcgacgcgtccgattgctgatttcgacgtctacatcgacaagctgacagagttcgtttacaaaaccaacctgtttatgaagccgattttctcccaggctcgcaaagcgccgaagcgcgtagttctgccggaaggggaagaggcgcgcgttctgcatgccactcaggaactggtaacgctgggactggcgaaaccgatccttattggtcgtccgaacgtgatcgaaatgcgcattcagaaactgggcttgcagatcaaggcgggcgttgattttgagatcgtcaataacgaatccgatccgcgctttaaagagtactggaccgaatacttccagatcatgaagcgtcgcggtgtcactcaggagcaggcgcagcgtgcgctgatcagtaacccgacagtgatcggcgcgatcatggttcagcgtggcgaagccgatgcaatgatttgcggtacggtgggcgattatcatgaacactttagcgtggtgaaaaatgtctttggttatcgcgatggcgttcacaccgcaggtgcaatgaacgcgctgctgttgccgagtggtaacacctttattgccgatacctacgtcaatgatgagcctgatgcagaagagctggcggagatcaccttgatggcggcagaaactgttcgtcgttttggtattgagccgcgtgtggctctgttgtcgcactccaactttggttcttctgactgcccgtcgtcgagcaaaatgcgtcaggcgctggaactggtcagggaacgtgcgccagaactgatgattgatggtgaaatgcacggcgatgcagcgctggtggaagcgattcgcaacgaccgtatgccggacagccctttgaaaggttccgctaatattctggtgatgccgaacatggaagctgcccgcattagttacaacttactgcgcgtttccagctcggaaggtgtgactgtcggtccggtgctgatgggcgtggcgaaaccggttcacgtgttaacgccgatcgcatctgtacgtcgtatcgtcaacatggtggcgctggccgtggttgaagcgcaaacccaaccgctgtaattcttttttaactctcacgcttaccctgaatattcagggtaagcggtttagctgcaatatattagtaaagtttattactgagtttgcgaataataaaaaaatcagtatataaaatatctcgatattattttatttatattcatgcgttgcatatgaaagtttatgcaccacagcaaatatctctccattcttagtgatctacctcaccttttaaacgcgcttgccgaattttgttatttactctgacgaaaaattgtcacgatacacgaaagtttttcacaggcggcgactcatggataaagaacgcatcattcaggaatttgtgcccggtaaacaggtcacactggcgcatctcatcgcgcatcccggcgaggaactggcgaagaaaatcggcgttccggatgcgggcgcaatcggcattatgacgctaactcccggagaaacggcgatgatcgccggtgatttagcgttgaaagccgccgatgtgcatatcggttttctcgaccgttttagcggcgcgctggtgatttatggctcggtgggcgcagtagaagaagcgttatcacaaaccgtcagtggtttaggacgcttattaaattatacgctttgtgaaatgaccaaaagttaatacgaggcattcatgaaacgaattgcgtttgtgggtaccgtcggggcaggaaaaacaacgttatttaatgcgttgcaggggaattataccctcgcaagaaaaacacagaccgtggaatttaatgataatggcgatattgatacgccgggtgaatattttagccatccccgctggtatcacgccttaattaccacgctacaggatgtggacatgctgatctatgtccacggcgcgaatgacccggaaagtcggttgcctgccgggttgctggatattggcgtcagcaaacggcaaatcgccgtcatcagtaaaacggacatgccagatgctgacgtcgccgcaacgcgaaagttattgcttgagacgggcttcgaagagccgattttcgagctaaacagccacgacccgcaaagcgtgcagcaactggtggattatctggcatctctcaccaaacaggaggaagcaggtgaaaaaactcatcacagcgaatgatattcgtgaagcacacgcgcgcggcgaactggcaatgtccgtggttctgcgcgccagcattattaccccggaagctcgtgaagtggctgatctgttgggttttaccatcaccgaatgtgatgaatcgatcccggtaacggcgtctgttcccgccagcgcatcagccgataaaaccgaaagccagcgcatccgtgaaaccattatcgcccaactgccggaaggtcagtttaccgaaagcctggtcgcgcagctgatggaaaaagtgatgaaggaaaaacagtcgctggaacagggtgcactgcagccgagctttaaatcggtgaccggcaaaggcggcatcaaagttattgatggcagcagcgtcaagtttggtcgtttcgacggcgcacaaccgcactgcgtaggcttgactgatctcgtgaccggagacgacggcagcagtatggccgctggtttcatgcagtgggagaacgccttctttccgtggaccctgaactacgacgaaatcgacatggtgctggaaggggagctgcatgttcgccacgaaggcgaaactatgatcgccaaagcgggcgatgtgatgtttatcccgaaaggctccagcatcgaatttggtacgacatccagcgtgaaattcctgtatgtcgcctggccggctaactggcaatccctatgaaagatttcatcaccgaagcatggctaagagcgaaccatacgctcagcgaaggcgcagagatccatctccctgcggacagtcgcctgacgccctctgcccgggagttactggaaagccgccatctgcgcatcaagtttattgacgagcagggccgcctgtttgttgacgatgaacagcagcagccgcagcccgttcacgggctgaccagtagcgatgaacatccgcaggcgtgctgcgaactgtgccgccagccggtggcaaaaaagccggatacgctgactcacctgtcggcggaaaaaatggttgccaaaagcgatccgcgcctggcttttcgcgctgttctcgacagcaccattgcgctggcagtgtggctgcaaattgaactggcggaaccgtggcagccgtggctggcggatatccgttcgcgtcttggcaacattatgcgtgccgatgcgctgggggaaccgctgggcgatcaagcgattgtcgggctttctgacgaagatctgcatcggctttctcaccagccgctgcgttatctcgaccacgatcatctggtgccggaagccagccacgggcgcgatgcggcgttgctgaatctgttacgcaccaaagtgcgggaaaccgaaaccgtcgcggcgcaggtctttatcacccgcagctttgaagtattacgcccggacattttgcaggcgctgaaccgcctttccagcacggtctacgtgatgatgatcctgagcgtaacgaagcagccgctaacggtgaagcagatccaacaacgactgggggaaacgcaatgattattgaacgttgtcgtgaactggcgttgcgagcgcccgccagagtagtttttccggatgcgttagatcaacgtgtgctgaaagttgcgcaatatttacatcaacaaggtctggcaacgcccattctggtcgccaatccgtttgaacttcgtcagtttgcgctcagtcatggcgtggcgatggacgggctacaggtgattgatccgcatggcaacctcgcaatgcgggaagaatttgctcatcgctggctggcccgcgcgggcgaaaaaacgccgccggatgcgctggaaaaacttaccgacccgctgatgttcgccgccgcaatggtcagcgccggtaaagcggatgtctgtatcgcgggcaacctctcttccacggcgaatgtgctgcgtgccggattacgcattatcggcttgcagccaggctgtaaaacgctctcatccattttcctgatgctgccacagtacagcggtccggcgttgggctttgccgattgcagcgtggtgccacagccgacggcggcacaactggcggatatcgcgcttgccagcgccgaaacctggcgcgccatcaccggagaagaaccgcgcgtggcgatgctgtcgttttccagcaacggtagtgcccgtcacccctgcgttgccaacgtccagcaggcgacagaaatcgtccgtgagcgcgcaccaaagctggttgtcgatggcgagttgcagtttgacgccgccttcgtgccggaagtggcggcgcaaaaagcgcctgccagcccgttacagggcaaagccaatgtgatggtttttccgtcgctggaggcaggaaatattggctacaaaatcgcacaacgacttggcggatatcgtgccgtcgggccattgatacaaggacttgccgcgccgatgcacgatctctctcgtggttgtagcgtgcaggaaattatcgaactggcgctggtggcagctgtgccgcgtcagacagaagtgaaccgcgaaagcagtttacaaacactggttgaatgaacggtcccgttctggaccctgataaagaggaaagcacaatggaagcattaggaatgatcgaaacccggggcctggttgcactgattgaggcttctgacgcgatggttaaagctgcgcgcgtcaagctggttggtgttaagcagattggcggcggcctgtgtactgccatggttcgtggtgatgttgcagcctgtaaagccgcgaccgatgccggtgccgcagcggcacagcgtatcggcgagctggtatctgtacacgttatcccgcgtccgcacggcgacctggaagaagtcttcccgatcggcctgaaaggcgatagcagcaacctgtaatcaccttgtgtgacgtcgattcgggcgtcacgctctctcctttttcattttaccttctgcggagggtagggggagcttttacctgaaatacgccacggaggcgggtatgaaactggcagtcgtcactggacaaattgtttgtaccgtacgccatcacggactggcgcatgacaaattgctgatggtggaaatgattgatccacaaggtaatcctgacgggcaatgcgccgtcgccatcgacaatattggcgcgggaaccggggagtgggtgttactggtgagtggcagttccgcccgccaggcgcataaaagcgaaacgtcaccggtcgatctgtgcgtgattggcattgtcgatgaggtggtgtctggcggtcaggtcattttccacaaataaggcagaacatcatgaatcaacaggatattgaacaggtggtgaaagcggtactgctgaaaatgcaaagcagtgacacgccgcccgccgccgttcatgagatgggcgttttcgcgtccctggatgacgccgttgcggcagccaaagtcgcccagcaagggttaaaaagcgtggcaatgcgccagttagccattgctgccattcgtgaagcaggcgaaaaacacgccagagatttagcggaacttgccgtcagtgaaaccggcatggggcgcgttgaagataaatttgccaaaaacgtcgctcaggcgcgcggcacaccaggcgttgagtgcctctctccacaggtgctgactggcgacaacggcctgactttaattgaaaacgcaccctggggcgtagtggcttcggtgacgccttccactaacccggcggcaaccgtaattaacaacgccatcagcctgattgccgcgggcaacagcgtcatttttgccccgcatccggcggcgaaaaaagtctcccagcgggcgattacgctgctcaaccaggcgattgttgccgcaggcgggccggaaaacttactggttaccgtagcaaatccggatatcgaaaccgcccaacgcttgttcaagtttccgggcatcggccttttggtggtgaccggtggcgaagcggtagtagaagcggcgcgtaaacacaccaataaacgtctgattgccgcaggcgctggcaacccgccggtagtggtggatgaaaccgccgacctcgcccgtgctgctcagtccatcgtcaaaggcgcttctttcgataacaacatcatttgtgccgacgaaaaggtactgattgttgttgatagcgtagccgatgaactgatgcgtctgatggaaggccagcatgcggtgaaactgaccgcagagcaggcgcagcaactgcaatcggtgttgctgaaaaatatcgacgagcgcggaaaaggcaccgtcagccgtgactgggttggtcgcgatgcggcgaaaatcgcggcggcaatcggccttaaagttccggaacaaacgcgactgctgtttgtagaaaccaccgcagaacatccgtttgccgtgaccgaactgatgatgccggtgctgcccgtcgtgcgcgtcgccaacgtggcggatgccattgcgctggcggtgaaactggaaggcggttgccaccacacggcggcaatgcactcgcgcaatatcgaaaacatgaaccagatggcgaacgccattgataccagcattttcgttaagaacggaccgtgcattgccgggctggggctgggcggggaaggctggaccaccatgaccatcaccacgccaaccggtgaaggggtaaccagcgcgcggacgtttgtccgtctgcgtcgctgtgtattagtcgatgcgtttcgcattgtttaaggagtaaccgatggcgcacgacgaacaatggctcaccccacgtctgcaaacggcggcaacgctgtgtaaccagacgcctgccgcgacggaatctccgctgtggctgggggtggatctgggcacttgcgatgtggtgtcgatggttgtcgaccgcgacggtcagccggtggcggtatgcctcgactgggccgatgtggtccgcgacggcatcgtctgggatttcttcggtgcggtcaccattgttcgtcgccatctcgacacccttgagcagcaattcggtcgccgttttagccatgtggcgacctcatttcctcctggtacggacccgcgtatttccatcaacgtgctggagtctgccggactggaagtgagccatgtgctggatgagccaaccgcagttgcggatctgctgcaactggacaacgccggtgtagtggatatcggcggcggcactaccggcattgccatcgtgaaaaagggcaaagtgacgtactcggcggatgaagccaccggcggacatcacatctctctgactctcgccggaaatcgccgtatttcgctggaagaggcagagcagtacaaacgcggtcacggtgacgagatttggcccgcggtgaaaccggtgtacgaaaaaatggcggacattgtggcccggcatattgaagggcagggcattacggatttatggctggcgggcggttcctgtatgcaaccgggcgtagcggcgctgttttgcaaacaatttccggcgttacaggtgcatttaccgcagcacagtttgtttatgaccccgctggcaatcgccagtagtgggcgagagaaagcggaggggatctatgcaaagtgaattgcaaacggcgctttttcaggcgttcgataccctgaatctgcaacgggtaaaaacatttagcgttccaccggtgacgctttgcggtccgggcgcggtgagcagttgcgggcagcaagcgcaaacgcgtgggttgaaacatctgttcgtgatggcagacagctttttgcatcaggcagggatgaccgccgggctgacacgtagcctggccgttaaaggtatcgccatgacgctctggccatgtccggtgggcgaaccgtgcatcaccgacgtgtgtgcagccgtggcgcagttgcgtgaatcaggttgtgacggggtgatcgcgtttggcggcggctcggtgctggatgcggcgaaagccgtggcgttgctggtgacgaacccggatagcacgctggcagaaatgtcagaaaccagcgttctgcaaccgcgcctgccgttgattgccattccaacgaccgccggaaccggctctgaaacgactaacgtgacggtgattatcgatgcggtaagcgggcgcaaacaggtgttagcccatgcctcgctgatgccggatgtggcgattctcgacgccgcgttgaccgaaggcgtgccgtcgcatgtcacggcgatgactggcattgatgcgttaacccatgccattgaagcgtacagcgcgctgaacgctacaccgtttaccgacagcctggcgattggtgccattgcgatgattggcaaatcgctgccgaaagcggtgggctacggtcacgaccttgtcgcccgcgagagcatgttgctggcttcatgtatggcgggaatggcgttttccagcgccgggcttgggttatgccacgcgatggcgcatcagccaggggcggcgctgcatattccgcacggtctggcgaacgccatgttgctgccaacggtgatggagttcaaccggatggtctgtcgtgaacgctttagtcaggttggtcgggcgctgcgaactaaaaaatccgacgatcgtgacgctattaatgcggtaagtgagctgatagcggaagttgggattggtaaacgaatgggcgatgttggtgcgacatctgcgcattacggcgcatgggcacaggccgcgctggaagatatttgtctgcgcagtaacccgcgtaccgccagcctcgagcagattgtcggcctgtacgcagcggcgcaataaatgccggatgcgacgcttgccgcgtcttatccggccgacgggattgcacatgtagggcggataaggcgttcacgccgcatccgccagtggcgcggtgcaattgccggatgcgatgcttgccgcgtcttatccggccttcgggattgcacatgtagggcggataaggcgttcacgccgcatccgccaataaataacaactaacagggagtaaaggcgatgggaattaacgaaatcatcatgtacatcatgatgttctttatgctgatagctgccgtagacaggatcctgtcgcagttcggcggttctgctcgtttcctcggtaagttcggtaaaagtatcgaaggatccggcggtcagttcgaagaaggctttatggcgatgggcgcactgggcctggcgatggttggtatgaccgcgctggcaccggtactggcccacgtactcgggccggtgattatcccggtttacgaaatgctcggcgcaaacccatcaatgttcgccggaacactgctggcgtgcgatatgggcggcttcttcctcgccaaagagctggcgggcggtgacgtagcagcgtggctatactctgggttaattctcgggtcgatgatggggccaacgattgtgttttccattccggtggcgctcggcattatcgaaccttctgaccgtcgttatctggcgctcggcgtgctggcgggcattgtgaccattccgattggctgtattgccggtggtctggtggctatgtactccggtgtgcagatcaacggtcagccagtggaattcacctttgcgctgatcctgatgaacatgatcccggtacttatcgttgcggtgctggtggcgctggggctgaaattcatcccggaaaaaatgatcaacggcttccagatcttcgccaaattcctcgttgcattgatcaccctcggtcttgccgctgcggtagtgaaattcctccttggctgggaactgatcccgggccttgatcctatctttatggcccctggcgataaacccggtgaagtgatgcgcgccattgaagttatcggctcgatctcctgcgttctgttaggggcgtatccgatggtgctgctgctgactcgctggtttgaaaaaccgctgatgagcgtcggtaaggtgctgaatatgaacaacatcgcggcagccggcatggtggcaacgcttgccaacaacatcccgatgtttggcatgatgaagcagatggatacccgcggcaaagtcatcaactgtgccttcgccgtttccgctgctttcgcgctgggcgaccatttaggcttcgcggctgccaacatgaacgccatgatcttcccgatgattgtcggcaaattgatcggcggcgtcacggcgattggcgtggcgatgatgctggtacctaaagaagacgcgagcgcggctaaaaccgaagcggaggcgcaatcgtgaacactcgccagctactgagcgtcggtatcgatatcggcaccaccaccacccaggtaattttctcccacctggagctggttaaccgtgcggcggtgtcgcaggtgccgcgctacgaattcatcaaacgcgaaattagctggcaaagcccggtgttctttacccctgtcgataaacagggtggtttaaaagaagcggaactgaaaaccttaatcctcaagcaatatcaggctgcgggcattgcgccggaaagcgttgattctggtgccatcattatcaccggtgaaagcgcaaaaacccgcaacgctcgcccggcggtgatggcgctctcccggtcgctgggcgattttgtcgtcgccagcgccgggccgcatcttgaatccgtgatcgccggacacggtgccggggcgcaaaccctttctgaacaacggctgtgtcgggtcctgaatattgatatcggcggtggcaccgcgaactacgccctgttcgatgccggaaaaatcagcggcactgcctgcctcaacgtcggcggtcgcctgctggaaaccgacagccaggggcgcgtggtttacgctcataaaccggggcagatgattgtggatgagtgcttcggtgccggtactgacgcccgttcgctgaccggcgggcagctggtgcaggttacccgccggatggcagagctgattgtcgaagtgattgacggaacgctctcgccgctcgcgcaggcattgatgcaaaccggtttgctgcccgcaggtgttacgcccgaaatcattacgctttctggcggcgtgggcgaatgttatcgccaccagcccgccgacccgttctgttttgccgatatcggcccgcttctggcaacggcgctgcatgaccatccgcgtctgcgtgagatgaacgtgcagtttccggcgcaaaccgtgcgcgccacggtgattggcgcgggtgcacataccctttcgctctctggcagcacaatctggctggagggcgtacaactgccgctgcgcaatttgccggtggcgatcccgattgatgaaacggatctggtcagtgcctggcaacaggcgctgattcaactggatctttgccccaaaactgacgcgtacgtgctggcgcttcccgcctcgctgcctgtgcgttacgccgcggtactgacggtcatcaacgcgctggtcgatttcgtcgcgcgttttccgaatccgcatctcctgctggtggtggccgggcaggactttggtaaagctctgggcatgttgttgcgcccacagctacaacaactcccgttggcagtcattgacgaagtgattgtccgcgcgggggactatatcgacattggtacgcctctttttggcggatcggttgtgccggtgacggtgaaatcactcgcatttccttcctgagggaacgacttatgaaactaaagaccacattgttcggcaatgtatatcagtttaaggatgtaaaagaggtgctggctaaagccaacgaactgcgttcgggggatgtgctggcgggcgttgctgcggcaagctcacaggagcgcgtggcggcaaagcaggtgttgtcggaaatgaccgtagcagacatccgcaataatccggtgattgcctatgaagatgactgcgtgacgcggctgattcaggacgacgttaacgaaacggcctacaaccagattaaaaactggagcatcagcgaactgcgtgaatacgtcctgagcgacgaaaccagcgttgacgacattgcctttactcgcaaagggttgacctcggaagtggtggcggcggtagcgaagatttgctccaacgcggacctgatctacggcgcgaagaaaatgccggtgatcaaaaaggccaataccaccatcggtattccgggcacctttagcgcccgtttgcagccgaacgatacccgtgacgacgtgcaaagtatcgccgcgcaaatctacgaagggctttcctttggggtgggcgatgcggtgattggcgttaacccggtgactgacgacgtggaaaacttaagccgcgtgttggataccatttatggcgtgatcgacaaattcaacatcccaactcagggctgcgtactggcgcacgtcaccacccagatcgaagcgatccgtcgtggcgcaccaggcgggctgattttccagagtatctgcggcagcgaaaaagggctgaaagagtttggtgtagagctggcgatgctcgatgaagcacgcgcagtgggcgcggagttcaaccgtatcgccggggaaaactgtctctacttcgaaaccggacaaggctcggcgctatccgctggcgctaacttcggcgcagaccaggtgacgatggaagcgcgtaactatgggctggcgcgtcattacgatccgtttatcgtcaacaccgtggtcggttttattgggccggagtatctctacaacgaccgccagattatccgcgcaggcttagaagatcactttatgggcaagctgagcggcatctctatgggctgtgactgctgctacaccaaccacgctgacgctgaccagaacctcaacgaaaacctgatgatcctgctcgccaccgcaggctgtaactacatcatggggatgccgctgggcgatgacatcatgctcaactatcagaccaccgcattccacgacactgccactgtgcgtcagttactgaatctgcgtccgtcaccggagtttgaacgctggctggaaagcatgggcattatggcaaacggtcgcctgaccaaacgggcgggcgatccgtcactgttcttctgatgacgcggagataacacatcatggatcaaaaacagattgaagaaattgtacgcagcgtgatggcgtcaatgggacaagcggcccccgcgccgtcagaagcaaagtgcgccaccaccaactgtgcggcaccggtgacctcggaaagctgcgcgctggatttaggttctgcggaagcaaaagcgtggattggtgtggaaaacccacatcgcgcggacgtattaacagaactgcgtcgcagcaccgtggcccgcgtttgtaccggtcgtgccggtccgcgtccgcgtacccaggcgttgctgcgtttcctggccgatcactctcgttcgaaagataccgtactgaaagaagtaccggaagagtgggtgaaagcgcagggcttgctggaagtccgctccgaaatcagcgacaaaaatctctatctgactcgcccggatatgggccgccgcctgtgtgcagaagctgttgaagcgctgaaagcacagtgtgttgctaatccggacgtgcaggtcgttatttctgatggcctgtcaactgatgcgatcaccgtgaactacgaagagatcctgccgccgctgatggcgggcctgaaacaagccgggctgaaagtcggtacgccattctttgtacgttatggtcgcgtgaagattgaagatcagatcggtgagatcctcggtgcgaaagtagtgatcctgctggttggcgaacgtccggggttggggcagtcagaaagcctctcctgctacgccgtttattcgccgcgtatggcgaccaccgttgaggccgatcgcacctgtatctctaacattcaccagggcggcacgccgccggttgaagccgcagccgtcattgtggatttggcgaaacgtatgctggagcagaaagcatccggcatcaacatgacccgataaggaggcatcatgccagctttagatttgattcgaccgtcggtaaccgccatgcgggtgattgcctccgttaacgccgaatttgcacgtgaactgaaattgccgccgcatattcgtagcctcgggctgatttctgctgattcagatgacgtcacctacattgcggctgacgaagcgaccaagcaggcgatggtcgaagtggtatatggtcgctcgctgtatgcgggcgctgcacacggcccgtcaccgactgccggtgaggtgctgattatgcttggtggaccaaacccggcggaagtgcgtgctggtctggatgcgatggttgcgaatattgaaaatggcgctgctttccagtgggcaaatgacgcagaaaacacagccttcctggcacatgtagtttcgcgtaccggttcttatctctcatcaaccgccgggatcacgcttggcgatccgatggcgtatctggtggcaccgccgctggaagcgacctacggcattgatgcagcgttgaaatctgccgacgtgcagttggtgacctatgtcccgccaccgtctgaaaccaactactcggcagcatttttaaccggtagccaggccgcgtgtaaagcagcctgtaacgcctttaccgatgcagtgctggaaatcgcgcgtaatccaatccagcgtgcgtaacggaggttgccgatgatcaatgcactgggattgctggaagtggacggcatggtcgccgcgatagatgcagctgatgccatgctcaaagcagctaacgttcgtctgctcagtcacgaagtgcttgaccctggtcgcctaacgctggtggtggaaggcgatctggcggcgtgtcgtgcggcgctggacgcaggttgtgctgccgcgatgcgtaccgggcgtgtcatcagccgtaaggagatcggtcggccagacgatgacacccagtggctggttactggctttaaccgccagccgaagcaacccgtaaaggaacccgacgcgccagttatcgtcgcggaatctgctgacgagttgttggcgctgttaacatcagtacgtcagggaatgacggcaggagaagtggctgcccactttggctggccgctggaaaaagccagaaatgcgctcgaacagctcttttctgccgggacgttacgtaaacgcagtagtcgttaccgtctcaagccccattaacctgtcggaggtgccgggtgtcctacaacacccggcattaacatcatgaaaaagacccgtacagccaatttgcaccatctttatcatgaacccttacccgaaaacctgaagctcacgccgaaggtcgaagtggataatgttcatcaacgacagacaacggacgtctatgaacatgctttgacaattaccgcctggcagcagatttac
